United States Patent 10,233,495 (METHODS AND COMPOSITIONS FOR SCREENING AND TREATING DEVELOPMENTAL DISORDERS) - sequence listing, part 61

SEQ ID NO: 552 - DNA, 5375445 bp, Homo sapiens (residues 1,791,816-3,583,630 of 5,375,445)
  misc_feature (865621)..(1125620): n is a, c, g, or t
cttgcctattctgaagattccaaataagtggaatcatacaatatggcctttggggttggcttctttcatttagcataaggttttcaaggttcattcataccgtagcatctatcaatgcttaattccttttatgtcaaataatatcccatttattggatataccacattttattgatccgtttaccaggtgacggacatttggggttatttccacttacaggctattataaataatgctgctataaacattcagttacaggtgatcgttttcgtttactacaggtatacatctaggagcagaattgctgggtcataaggaaaccctgtgtttaactttttaagtattgccaacctctttttcaaagtggtggcaccattttatgatcctgtcagcaatgtgtgaaatttctgtaccttggctttgcatgggaaacagttaaatgaaaatttcctgagaaagtacagtgatagttggcaaaggtttgggagggtagtggggagagggggatacagagaggatggttaatgggtacaaaaatacagttagatagaaggaataagatctagtgttaggcaggacaatagagtgactgtagttagcaataatttattgtatatttcaaaataactcaaagagtgaaactgcaatgttcctaacacaaagaaataataaatacttgaggtgatggatatcccaatttaccttgatttgatcattacacactgtatgtttgtatcaaaatatcacatataccccataaatatggacaactattatgtatccataactaaaaatgcaaaattatatttaaaaaatcatttcataacacaaatcaaagctttgaacttgtaccctttgtagacttatagtcaaattgtaactactcaagtggaacagaacccataaccccctgtctttccctcctcccacctgataagaaaataacagaaactcttatggcccagtggtacacttggattgcctgggaagggaacataaaacccaccatggaaggacactccagttacccaggcaacgtggaatttacatgcatatgcacaaaacaagccctatttaaaataaatacacaatcacacatccaccttggagcaagaatcagcaaacagataaacaaaacaacaaaaataagactgtaggattagaaccataaggacttctgataaacctatgactgagacagtaaattgaatatatttaaaattattaaagggataaaaggagtagaaaacaaaaggagagaacacaatgcacaaatcaacatctagcatatgtgaaaaataatccggtagaaagacaggttcccagcaatgtgaagagaataggggggtgaaaagagaggaaaaagccatctggacttataaaaatgtgtctgtttctcagcggctgtgttttagtttcatggcattaagaaacacaatatacttcttggtaaatggcattgtacttaaatacttatgctcttattctaaataactccaacagctgtatttcttcaacctttggcaatgagttctataattagagtatggtaatagatcccggatcagaagccagaaaagcgtaaccaggtgtcctcgccacttagtccctcatgctttggggaccacatgtctctgatgatgccgcttcatttcttataatggtccactttatcttagctctgaatactatcagctgaattcaacttattccttcctttctattttctataacaaccaaaaataaataaataaggcatagatgctgctctgttcttaaatgttttcctctttcagaagctggcacccattttcccaactgagaaatgtattactcagctttctatttcagaaattttcacattttgcaatcgatggattcttcagtgacagtgatctgtgtatagtaatttatagacctttctggctattcaggtctttgtcatgcattccaatagatctattctactatttcttttttgcactgtgaatgctcccactttgtgtcttactcccttctcccccaagagtcattctggccatttgctttgtcttcccctagaaaacagaatgctggctattctttaataaacttgtggttgcttgtgaatgcatgacatgtatttttaccttagagaaaacctaaatgtctcatatgttaatttttggacaaactttaaagttgactcatgaagaggattctcagtattcacatctttactttatgttctttacaaatgtctccaatttaaattaacagctcctcagaatcactgtccttaaactctggggacaaaattcttacttttcaaaaatgtcagattcttcaagagttataattcatacctttgccccagatacttgagaaaaagaatttctttttattttttaaaacaaaaattcttattagaaacccaggcacagaaactcatcatgtgtcagtgatagaacacttagggtgttgaaatacttgctatctgtatttaagtttgttgaagaatgctttgcacatggggacagtcagatctggtattaggaggcctttggaaactcccccctgctataaaatcagtggaagtcatgaagctttctactcacaactgagtcttttctgaatccaataagaagtgatcctattctgtcagatcagggtctgggtcctcatgaatcacttcctttgttggtgctgtgaatgcatgtgttgggccaactggactgagaccaaattaggggcacctgcataacatactataatcaaacatagttacttcagtcctctgtgtaaaaataactatgcgaagaacttccagatcagtgaagagcaagggcctctgaaaatctgcttatccacaaaagcaatgagaacactgacaaaaagttgtcaaaatcaactttctcaaaactgaactctggaaattaattagtgaagttaattactgctcctttgcaacaacccaaggagaatttatgcagaagaatggccgacactcagtaagaacagtgagttttgtggtattttaactttctataactcatcacgtttgccccagttttgcggcagccttgagaaccaacaacatcacaattagggtagcagccactagaggggacataatgagtttagaggtccccaaaagcatcattcctagaggattttccaattttacctgtttggcaactctttggaaatccctcacttacagaggttatatttatttgacctgactgagagctttctcagtccaaacagccttttccatagggcatttgctgaaaacaatcagtagtaattgtttaacatcatagctgccagagtgaggatatcagttggggcaaacaaaaagctaactaaaaaactgagaaggaaaagcagtagaatgaaaccccactgggagttttgaacagctttaatatactccagggaatctagcagtccacatgcatgtacagggctgtatgcatgctcataaaagaccagagaaggccctaatctcttacctctagctgatcctgagtcccaaagcaagcaggaagtgaaagctaaagcaggagtaaaatgtcatagaatattgaaggcatgcccaaataggttgacaaagctaatcagcaagggctgggagatttaattgttcaaggcatttaaggaactctctagccaatcattaactgactacaaagttaaccaaacagacttcagtagccatatgcaacaaagaatacaaactgtaaagtagtcatttaggaaagtcactgaacaaacaaatggcaacaacagcaagaacaacaatactaacaagaaacccttaaaaatgtgaatctgattataagggttgtcatattacattatttaaaatacctagtttatagaaaaaattatgagaaatataaagaaacagaaaaatatgacctttacacagagaaaaaaaataagtcaaaaaagactgtctctgaaggggcctatacattggatttaataggcaaaaactaaattagctcatctgaggaactaaagaacacaacaactaaagacttttaagaaaatatgaggctgggcgtggtggctcatgcctgtaatcccagcactttgggaggccgaggcgggtggatcacgaggtcaggagatcaagaccatcctggctaacacggtgaaaccccgccttgacttaaaaaaaaaaaaaaaaattagtcgggcatggtggtgggtgcctgtagtcccagctactcgggaggccgaggcagggaacggcgtgaacccaggaggtggagcttgcagtgacccgagatcgcgccactgcactccagcctgggagacagcaagactctgtctcaaaaaaaaaaaaaaagaaaagaaaagaaaacacgtgtataatgtctaacagattgtcaacagggaaatcagaaaatataaacaaaaaacaaatagaaattctggatttgaaaagtacattagtggaaatgaaaaattcactggaagagctcaacagcagatacatgctatcagaataaagaatcaaaaactgggagataagtcaaagtcaattgagattatccagtcaaaaaagggaggcagaaaagaataaaataagactaacaaagccatagagaaccatagcacaccaccatatagtatcaatatatgcacaatgggagtccctaaaagagagaagagaaagtagaagaaaatttttgaagaaataatggctgaaaacttccatacttgatgaagaatgttaatctatatatcctagaaactcaacaaactctgtagggtaaactcaaacagatctgcacttggtgcattataaccaatgataactgtcttttatacttatacacttggcacattataaccaaactgtcaaaagtcaaagccaaagaaaatcttgaaagttgcaagaaagaagtgattcatcacgtgcaataatcttcaataagattaatagctactttcggctgggcgtggtggctcacacctgtaatcccagcattttgggaggccaaggcagacggatcacgaggtcaggagatcgagaccatcctggctaaaacagtgaaaccctgtctctactgaaaatacaataaattagccgggcttcgtggtgggcacctgtagtcccagctactcgggaggctgaggcaggagaatggtgtgaacctaggaggcggagcttacagtgagctgagatcgcaccactacactccagcctggctgacagagcaagactccgtctcaaaaaaagaaaaaaaaaaattaatagctgctttcttaggaactatggaggtcagaaggcagcaggatgacatacccaaagtgcaaaaagaaaaaacactgtcaaccaagaattctatgtctttcaaaattattcttgaaaaacaaagaaattggccagtcatagtggctaatgcctgaaatcccagcactttgggaagctgaggcaggtggatcacttgaggtccgaagttctagaccagcctggccaacatggtgaaaccccgtttctactaaaaatacaaaaatgagctgggcatggtggtgtgtgcttataatcccagctactggggaggttgaggcaggagaattgcttgaacccaggaggtagaggttgcagtgagctgagatcacgtcactgcactccagcctaggcaacagagtgagattccatcaaaaaataaaaaataaaagaaagagaaaagaaaagaaaaaagaagaaattaaaatgctattacattttgtgaaaaagtgagtttcttgctagcagacctctcctacaagaaatactaaagggagcactgcaggctgaaatgatgtaataccagacaggaacttaaaaccacatgaagatatagagaacacaagaaaaagtatctacacaggtaagcataaaagacagtaagaataaattttttatttgtgacacttttatctcctgatttgaaagataactgaaggccaggtgcagtggctcacacctgtaaccccagcacttcggaaggctgaggtgggcagatcatcctacccaacatggtgaaatcccatctctactaaaatacaaaaattagcctggcatggtggtgtgtgcctgtaatcccagctgcttgggaagtggaggcaggcaaatcacctgaacctgggaggcagaggctgcaggaagccaaaattgcagcactgcactccagcctgggcaacagagtgagactccatctcaattataaaactgtgtttatggtttataatgtataaaaagtaccatttgtattataataatagcacaaaggaaaggagagcaattgggattatatttgagcaaaattttatatacttttgagattaaattagtattatgcaaactagcttttatacatgaagatgttaactgtaattcttagagcaaccactatgaaaataactaaaaaatacaacataaaagaaacaatggaattaaaatagtaaagtagaaaatatctacttaacataaaaaaaatcagtaagggaggaatagacggcaaaaaagaataggagacatatggaaagtaaatagcaaaatggtagatataaagtcctaccttatcagtaattatactaattactaagtataattatcagtaattatactaattataaataaattcaacacttcaatcaaaaggcagattctggcagaatgaattaaaaatatgtttcagcttgaaagcaaaaggatgcaaaaagataccaagaaaagggtaacgaaaagagccccggaggcgtgaaaccaagatggccgaataggaacagctccagtctacagctcccagcatgagcgacacagaagacgggtgatttctgcatttccagctgaggtactgggttcatctcactggggagtgtcggacagtggctgcaggactgagtggagcccaccgcagctcaaggaggcctgcctgcctctgtagactccacctctaggggcagggcatagccaaacaaaaggcagcagaaacctctgcagacttaaatgtccctgtccgacagctttgaagagagtagtggttctcccagcatgcagttggagatctgagaacagacacactgcctcctcaaatgggtccctgacctccaagtagcctaactgggaggcacccccgagtaggggcagattgacacctctcacggccgggtactcctctgagacaaaacttccagaggaacgatcaggcagcaacatttgctgttcaccaatatctgctgttctgcagcctcagctgctgatacccaggcgaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatgaggaaaaaacagagcagaaaaactggaaactctaaaaagcagagcgcctctcctcctccaaaggaatgcaactcctcaccagcaatggaacaaagctggatggagaatgactttgacgagtcgagagaagaaggcttcagacaaactactccgagctaaagaaggaagttcaaacccatgtcaaagaagttaaaaaccttgaaaaaaaattagatgaatggctaactagaataaccaatgcagagaagtccttaaaggacctgatggagctgaaaaacaaggcataagaactatgtgatgaatgcaccagcctcagtagccgatttgatcaactggaagaaagggtatcagtgatggaagatcaaatgaatgaaatgaagcaagaagagaagtttagagaaaaaagaataaaaagaaacgaacaaagcctccaagaaatacgggactatgtgcaaagaccaaatctacgtctgattggtgtacctgaaagtgatggggagaatggaaccaagcaagagcaaacacattcaaaagctagcagaaggcaagaaataactaagatcagagcagaactgaaggaaatagagacacaaaatatccttcaaaaaatcaattaatccaggagctggttttttgaaaagataaacaaaattgatagaccgctagcaagactaataaagaagaaaagagagaagaatcaaatagacacaataaaaaatgataacggggatatcaccactgatcccacagaaataaaaactaccatgagagaatagtataaacacctctacgcaaataaacgagaaaatgtggaagaaatggataaattctttgacacatacaccctcccaagactaaaccaggaagaagttaaatctctgaatagaccaataacaggctctgaaattgaggcaataattaatagcttaccaaccaaaaaaagtccaggaccagatggattcacagccgaattctaccagaggtacaaggaacagctggtaccattccttctggaactattccaatcaatagaaaaagagggaatcctccctaactcattttatgaggccagtatcatcctgataccaaagcctggcagagacacaacaaaaaaagagatttttagaccaatatccctgatgaacatcaatgcagaaatcctcaacaaaatactggcaaaccgaatccagcagcacatcaaaaagcttgtccaccatgagcaagtgggcttcatccctgggatgcaaggctggttcaacatatgcaaatcaataaacgtaatccagcatataaacagaaccaacgacaaaaaccacatgattatctcaatagatgcagaaaaggcctttgacaaaattcaacgaccttcatgctaaaaactctcaataaattaggtattgctgggacatatctcaaaataataacagctatctatgacaaacccacagccaatatcatactgaatgggcaaaaactggaagcattccctttgtaaactggtacaagacagggatgccctctctcaccactcctattcaacatagtgttggaagttctggccagggcaatcaggcaggagaaggaaataaagggtattcaattaggaaaagaagaagtcaaattgtccctatttgcagatgacatgattgtatatctagaaaaccccattgtctcagcccaaaatctccttaaggtaataggcaacttcagcaaagtctcaggatacaaaatcaatgtgcaaaaatcacaatcattcttatacaccaatagcagacaaacagagagccaaatcatgagtgaactcccattcacaattgcttcaaagagaataaaatacctaggaatccaacttacaagggatgcgaaggacctcttcaaggagaactacaaaccactgctcaatgaaataaaagaggatacaaacaaatggaagaacattccatgctgttgtgtaggaagaatcaatattgtcaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacgaggctacagtaaccaaaacagcatggtactggtaccaatactgttgtattggtctataccagagagatagaccaatggaacagaacagagccctcagaaataatgccacatatctacaactatctgatctttgacaaacctgacaaaaacaagaaatggggaaaggattccctatttaataaatggtgctgggaaaactggctagccatatgtagaaagctgaaactggatcccttctttacaccttatacaaaaattaattcaagatggattaaagacttaaatgttagacttaaaaccataaaaaccctagaagaaaacctaggcattaccattcaggacataggcatgggcaaggacttcatgtctaaaacaccaaaagcaatggcaacaaaagacaaaattgacaaatgggacctcattaaactaaagagcttctgcacatcaaaggaaactaccatcagagtgaaaaggcaacctacagaatggaagaaaatttttgcaatctactcatctgacaaagggctaatatccagaatctacaatgaactcaaacaaatttacaagaaaaaaacaaacaaccccatcaaaaagtgggcgaaggatatgaatggacacttctcaaaagaagacatttatgcagccaaaaaacacatgaaaaaaatgctcatcatcactggccatcagagaaatgcaaatcaaaaccacaatgagataccatcttacaccagttagaatggtgatcattaaaaactcaggaaacaacaggtgctggagaggatgtggagaaatgggaacacttttacactgttggtgggactgtaaactagttcaaccattgtggaagtcagtgtggtgattcctcagggatctagagctagaaataccatttgacccagccatcccattattgggtatatacccaaaggattataaattgtgctgctataaagacacatgcacacgtatgtttattgcggcactattcacaatagcaaagacttggaactaacccaaatgtccaacaatgatagactggattaagaaaatgtggcacatatacaccatggaatactatgcagccataaaaaatgatgagttcatgtcctttgtagggacatggatgaaggtggaaaccaccattctcagcaaactattgcaaggacaaaaaaccaaacaccgcatgttctcactcacaggtggaaattgaacaatgagaacacgtggacataggaaggggaacatcacacacaggggcctgtggtggggtcactgggtggggagggatagcattaggagatacacctaatgttaaatgatgagttaatgggtgcagcacacaaacatggcacatgtatacatatgtaacaaacctgcacgttgtgcacatgtaccgtaaaacttaaagtataattaaaaaaataaaaaaataataaaataaaaccctagtggcttaaaaaaagaaagagccctggagtagctatagtatcagacaaaataccagtgacgattttaagaaaacaatattttataacaaaaacattagcagagacaaagaagggtattttacagtaattaaatggtaaatctatcaagaacagaaaatatttttaaacatatatgcatctaacaacagagagccacaacacatgaagcaaaaactaacagaaagaaaggaagaaataaacaatgcaacaataatagttggagacttcaatattgtacttttgataatggataaaacaactaggcagaagactgaaaagtagatcgaagacatgaacaacactataaactaagctaaactagaactaacagatatctatagaacacttcacccaagaacagcagagcacacattcttctcaagtgcatatgaaacattttccagaattaactgtgtgttaggccataaagcgaaccttaatatatttaaaagggttagaattatacaaagtatattctctaaccacaaggaaataaaattagagtcaataatagaagaaaatttgagagtttataaatatgtaaagattaaacaacacactttttttttgtttttttgggtttttttgagatggtgttttgctcttgttgctgaggctggagtgcaatggcgcaatctcagctcactgcaacctctgcctcccaggttcaagagattctcctgcctcagcctcccgagtagctaggattacaggcgcccatcaccacacctggataatttttgcatttttagtagagacagagttttggcatcctcgaattcctgacctcaggtgatctgctcacttaggcctcccaaactgctgggattacaggcgtgagccaccatgcccagcccacactgtttttttaaaactttcattttaggttcagggtacctgtgcaggtttgttatatagataaacttgtctcacaggggtttgttgtacagatcatttcaacaacacactaaaatagccaatgggtcaaagaataaatcaaacggaaattagtaaatactttgataagaatgacaatgaaaagacaacataccaaaatttatgggatatagccagatagaccaagaggggaaaaaaggcctcaaattactacattagaaataagtgagaagccttcactaccactgtcaaagaaataaaaggaattataaaggaatgctataaataattgtagatcaaaacgttagataacttagagaaaaaggatagattcctagagaaacacacactactgaaattgactcaagaaggccgggcgtggtggctcacgcctgtaatcccagcactttgggaagctgaggtgggaggatcacaaggtcaggagatcgagaccatcctggataacatggtgaaaccccgtctctactaaaaatacaaaaaaatagccgggcgtggtggcaggcgcctgtagtcccagctacttgggaggctgaggcaggagaatggcatgaacccgggaggtagagtttgcagtgagccgagatggcgccactgcactccagcctgggcgacagagcgagactctgtctcaaaaaaaaaaaaaaagaaattgattcaagaagaattagaaagtctgaattacatgtaaagagattgaattactaataaaaatcttccacaaaaaaagtctcagggaaggctgggacaatatggcagaatagaagctatattagtctgttctcacacagctataaagaactacctgaaactgggtaatttatgaaaaaaaaaaaaaaaaaagaagtttaactgactcacagttccacaggctgtacaggaagcatggttgggagacctcaggaaacttacaatcatggcagaagggcaaagtggaagcaagcatgtattcacatggcagcaggagagagagagtgaagggggaagtgctacacacttgcaaacaacaagatctcatgagacctctgtcaccagaactgcaaggagaaattccactctcattattcaatcaccttccatcaggtcctttccccaacactgggaattacaattcaacctgagatttgggtggagacacaaagctataccattcaacccccaactggaacaccaaattttaacaactatttgcacacagaaaagcacacatcacaagaaccaaaaatcaggtgagcaatcatagtgcctggttttaacttcatatcatagaagcattgaggagggcagaagaaagagtcttgaattgctaatgccaccccaccctcacacccaggcagctgctgtctggcacagagagagaatcagtgcactttggggagggagagtgcagcagctggggaactttacattgaactcagtgctgctctgtcacagcggagaacaaagctgtgctgggcttaggtagcacctatgcatgaagggaacatttggaccagtcctagccagaggggaattgcccatcccagtggtcggaacttaagtttcttggcaagccttgtcaccgagggcaaaagtgctatggggtcctaggtaaatttgaaaggcagtctaggacacaaggattgcaattcctatgcaactcttaggcagcttctgggagctctctggctcccagacagcatttcttgatacacccagggcctgggggatctccttaccctgaagggaaggatcttgggcaaggcccagtcctgtgctggattcaggtctgacacagtgcacccagtggtgatggccacagaagtgcttgtatcaccattgctcagtttcaggtggctcagcacagagagagagagactctatttgtttgggaaaaagtaaagaaaaggaacaagagtctctgcctggtaatccaggagttgcctaggaattgcaatcgtaggagttcattggctgggtgtaactccaatgaactagggtgacacatgactagagagataccagctggcgccatctctccctcaacactaggcagtacagcttgacaaaagtgactccttcctggccgggtgcagtagctcacgcctgtaatcccagcactttgggaggctgaggtgggtggatcacttgaggtcaggagttcaagaccagcctggccaacatggtgaaatcctgtctctactaaaaataaaaacattagccaggtgtggtggcacacacttgtaatcccagctacttgagaggctgagccaagaggatagcttgaacccagtaggcagaggttgcagtgagcccagatcacaccactgcactacagcttgggtgacagagggaaactctggctctttaaaaaaaaaaccaaaaaacaaacaacaacaacaaacaaacttcttccttctccttaaggaaaggaaagcaaaaaagtaaagagaactttgtcttggattttggataccagttcagccacggtaggatagggcaccagccagagtcatgaggtccctgttccaggccctaactcccgggtgacacttctagacacacaccttgagccaacctgctgccttgagggaaggacccagtcccagcaggattcatcatcgactgactaaagagcccttgggccctgaataaccaccagtgatatccagggaatacgcaatggtccttgggctctgagatgagctggcttcaggggtaacccagcacattcccagctggggtggctacagtgaaagactcctgtttgagaaaagcagaggcaaaggaaggtgaaatttgtcttgtaccctaggtaccagcttggccacagtgaggtagagcaacaagcaggctcttggggtccctgaggctaggtctaggctctagacagcatttctagacctgccctgggccagagaggagcccactgccctggagggcgagtcccaagcctggcagcgttcaatgcaagctgatgaaagaatccttatgctctaagtgaatattggcagtggcctggcagaagcccatatggacaggcggcggtggtggccatagggagaggttcctctgcccgtggaaaggggagggaagagtgaaaacattttgtgttgtggtttgagtgccagcttagctgcagtacaacagaatagcatgtaacttgctaaggtttttgactccaatctctggctctgagacagcatttctggatacacccagggcctgggggaattcatcaccctgaagggaaggatcttgggcaaggcccagtgctatgctggattcaggtctgacactgacacagtgcacccagtggtggtgaccacagaggtgcttgcatcaccacacccccagtttcagatggctaagcacagagacagagacagagagagagagagagagagagaggcagagagaaactgactccatttgtttgtttgggaaaaagtaaagaaaatgaacaagagtctctgcctggtaatccagagagattttcttgatctaatctgagaccaccagagtaatacctctcaagtctgcaaaaaccacagtgttattgggcttagggcccacgtccctttgaatacctaaaaagccttcccaagaaggacaggcacaaacacgcccagactgtgaagactacaacaaatacctaactctgcaatgcccagacactaacagaacatctgcaagcatcaccaccatgcaggaaaacgcaacctcaccaaataaaaggcaccagggaccaatcctggagaaacggggacatgacacttcagacaaaaaaattcaaaacagctgttttgagaaaactcaaagaaattaaagacaacacagagaaagaattcagagtgctatcagataaatttaacaaagagattacggtaatttaaaaaatcaagtagaaattctagagttgaaaaatgcaattgtcatgctgaagaatgcaccgaatctcttagtaacagaaatgaccaagcagaagaaagaatttgtgagcttgaagacagcctacttgaaaatacacagtcagaagagttaaaagaaaaaagaatacaaaagaatgaagcaagcctacaagatctgggaaacagcctcaaaagggggcaaatttaacagttactgacctcaaagaagaggtggagaaagagatggcatagaaacttgattcaaagggataaaatcagagaaattcccaaacctagagaaagttatcaacattgaagtacaagagggttatagaacaccaagctgatttaacccaaagactacctataggcatttaataatcaaactaccaaaggttaaggctaaaggattctaaatgcagcaagagaaaagaaacaaataacatataatggagctccaatacatttggcagtaggtttttcaggggaaacctcacaggccaggagagagtagcatgacatatttaaagagctgaaggaaaaaaacttttaccctaggatagtatcctttaagcatgaaggagaaataaagactttccagagaaacaaaatctgagggattttatcaacaccagacctgtcctacaggaaatgctgaagggagttcttcaatctgaaagaaaaggacattaatgagcaaggagaaatcatctgaaggtacaaaactcattggtaatagtaagcacacagaaaaacagaatattataacactgtaattgtggtgtgtaaacttttcttaagtagaaagattaaatggtgaaccaatcaaaaataactacggcaatttttcaaggcatagacagtacaataagacatagagaaacaacaaaatgttaaaaagcaggggacaatgaagttaaactaacggttttctttttgcctgtttatttatttatgcaatcagtgctaagttgtaatcagtttaaaataatgggttataagatagtatttgcctggctcatggtaacctcaaatcaaaaaacataaaatggatatacaaaaaatgaaaagcaagaaattaaagcataccactagagaaaatcgccttcactaaaaggaagacaggaagggaggaaagaaggaaagaagaaagagaagaccgcaaaacaaccagaaaacaaataacaaaatggcaggggtaagtttatacttaaaaataataacattgaatgtaaaaggaataaactctccaatcaaaagacatagactggatgaatggatgaagaaacaagacccaatgatccactgcctacaagaaacacatgtcacctattaaagacacacatagactaaaaataaaggaatggaaaaagatatttcatgccaatggaaactaaaaagagcaggagtagctatacttatataagacaaaatagatttcaagacaaaaaccgtaagaagagacaaagaaggtctttatataataatgaaggagtcaattcaacaaaaggatataacaatggtaaatatatatgcttccaacactagagcagccagatatataaagcaaatattattagaactaaagagagagatagaccccaatacaataataagtggagactttaacaccccacttcaagcattggacagatctcgcagccagataaccaacaaagaaacattgaacctagtctgtactatagaataaatggaattaatagctttttacatacattggggaagagccagtgtcttcagtaagtgatgctgagaaaattggatatccatatgcagaagaatgaaatgtgatccttatctcttgccttatacaaaagtcaaatcataacggattaaagagtcaaatctatgaactccagctattgaaactgctacaagaaaacattgggaaaactctccaggacatttgtctgggcaaaaatttcttgagtaatatcccacaagcccaggcaacccaagcagaaatggacaaacgggatcaaattaaattgacaatcttcttcacagtaaagcaaacaatcaacaaagtgaagagacaagccatagaatgagataaaatatttgcaaactgtttatccaacaaggaattaataactagaatatattaggagctcaaacaactatgtaggaaaaaatttaataatctgattaaaaatgggcaaaatatttaaataggtatttctcaaaagaagacatacaaatggcaaacaggcatatgaaaaagtgctcaatgtcactgatcatcagataagtgcaaatcaaagctacaatgggacatcatcccatcccagtgaaaatggcttttgtctaaaagtcaggcaataacaatgctggcaaggatgtggagaaaagggaacttttgtacactattggtgggaatgtaaattagtgaaaccgcaatggagaactgtttgaaggttcctcaagaaactaaaaataaagctaccatacaatccagcaatcccactgttgggtatatacccaaaataaaggaaatcagtatataaaagaaatatctgcactcctatgtctgttgcagcagcattcacaatagccaagatgtgcaagcaacctaaggtccatccacaggtgaatggacaaagaaaatgtggcatatatatacaatgaagtattcagcatgaaaaataatgagattctatcatttgcaagaacacgaatggaagtggagttcattatgttaagtgaaataagccaagtacagaaagacaaacatcacatgttcttatttatagaatctaaaaatcaaaacaattgaactcatggagatatggaatagaaggatggttaccagagcctgggaaagatagtggggggctggggagtgcagtggggatggttaatgggtacaaaaatattattggaaagaataagacctagcctttgattacccaacagggggactatagtcgataataatttagttgtacattttaaaacaactaaaagagtaaaactggactgtttgtaacacaaaggataaatatctgagggaagggatacccaagtttccatgatgtgattattatgcattgcatacctgtaccaaaatacgtacttcatgtctgtaccaaaatatatacacctactacatagccacaaaaattaaaaataaaattatttttaaaaagcccagactcatatagcttcagtggtgaactctatcaaatgttaaggaataattattaccaagtattcataagctattccaaaaaagtagaagaggagggaacacttcccaactcattctatgtggtcagtattatccttataccaaaatcagataaagatatgacaagaaaactacagaacattatctcttatgattatacctgcaaaaataatcaacaaaatactagcaaactaaatccagaaacataaagggattataagccacaacaaagtatgatttgtctcaggtatagaaggttaatttaacatagaaaaatcaaaacacgctgcattaatagaagaaggacacaacctacataatcgtcttaagggatgaaaaaaaaaatcacttgacaaaacctgacaccctttcatgataaaacatttgataagctagaaacagagggactttccccaacctcctcaatgctatctataaaaaacccacacctgacattatacttaatggtaaaagacagaatgagttcctctaagattaggaacaagataagggtgtctgctcttgatggctttattcagcattgtattggaggttccagtaggggcaattaggcaacaagaagatataaaagacatctaaactggaaagaaaaaataaaagatatctacatttggagatcacatgatcttacatatagaaaaccacaaggaattcactaaaaattattagatctagtgaggtcaggaagattgaaggatacaaggtcaataaaaaaatcaattgtatttttatacactagcaatgaataattttaaaataaagttaagaaaacaattacctttacaatagtatcaaaaagaacaaaatacttcagaataaatgtaatgaaagaaatgtaaaacctatcaccgaaaactgtgaaacatttttgaaagcaattaagacgtaaattaatgagatgacatcccattaagtcacaagtagacttaatattaagatggcaatatttgccaaattgatatacaaattcaacctaagcaatatcaaaattccagctgctatttatgtagaaatggacatggtgatcctaaaatttatatgaaaatgtaagggacccaaaatagtcaaaacaattttaaaaataacactgtttttgaggtgatgaaaatgttctaaaattagatagtggtgaaagttgcataactccatgaccatgttaaaaatcaccaaattgtacactcctataagggtgaactctttggtatgtgaatttatctcaatgatttttttaaaaagtccccaaaacctgtggcagacatgtcagggcaaatgtattgatgggcatgcagtttattttagtttcttcctatttctttcacattggacgttggagtatttgtgctatgtttagaatcattgatccagagttattttctagaatagtccatgtctgagttcagaattattagttactgcagaaattggtgtttctaagaattttttagtttggccataaagagcaacacttaccagttgtgatcaattcttgttctgtaaatgttcttcaatgaaacaataattcttaggatcttttttaagacatataagagctctattttgcatagtcttcaacatataataaaagtgcctagatggaaagaattgttaaaaacagaccagatattacagtttttcactctcttggttaaaatcaaggaaacacaatcaagtagttttcctattcttctatgccagatgttggtctttgtaagatcagctcatctggactcctaaattatggatttctgagtttcacaaacactaggttaacaagcttccaaggataagtaatgaaataaatacttcatggagagctgcaggcctagatctccaaatctaatttcagattccatctccctgctttcttcctttttgacttcttgaatttagtagacaaagataaggaaaaaaagcctaaggcgatttgaagaaaccagttatcacatactgaaagattcttttaaggcatcttatgtcttctggagagaatattaaaggaaacgggctttgcatatgaaagtttgtggcagagataaaccagtaattaggagctagttattttagctcctctcctggaaaattagccccagtattagagtctctttatagggaaaagtcacttcatgacacataaaactgtgacaggcagagccatctatatcagttgaggttagtgctgtggtacatacagcagagaagaggacctataagcaatgtcaatggaaagaagatgcccttgtgttaagattgacagaaaacagacatataaatgcagatatttaaaggcatggcccagaagatggtggagctaaagatgaaggaagttgtacagagaacttacatggaattatccataaaattaaaaaacaatttagctgccttttactgaacacttcctaagtcctcattcttcatatatgttgtcttaagggtagatgcaattatttctattttaaagagatagagactaaagttaagggagatttattaactaacccaaggtacccaagttggtaagatttatctggggtttgcaccaaggtgtgagattcaaaagcctatccacttgactataatcttgtattcccgccctaaataaaaaatggatctcacctagtgaaggcctctattagaaagacaaaggcagaacattctttgtttgcttcccattcccaaacaactatcaatagtgtcctatttctttcattctgcaaatatctgttaaatgcctatttgtgctatgtgcttgaaacagtctttaaaaggctatacttggattgaatggaaaaacactagggtgagaaatccaaaggagaattgcactgtatcattttaactattctgattcagcactttagctgggcttcatgctaaagatctctttacaaacaggtttattaattaccagctatcagcttacatatcagcttattatcagctatcagcttactctaaaagagaggaaaaataattatatttctgtacttataatgatttcccatataaacatccttacattcacttggattgttatataataaacaaatctttcttagctaacacttcaaagacagttattggtcttctaattacattttaaagaatgaaactgaaaaaggattgatagctttgtaaccagttctcctgtaacaactacggaaggcaaattagatggtttgatgtttatgttaccatgttgcttttttccatcatcccaatctctaatacatataagatgaaaaattattgatccaaacccaggcctgaaaagatagaaaataatatgtgctgaaacatgggacaaaaatactttgtttgtcctccttaaaaccctctgcagcttgaaaaacctcccacgtgcacagcagaagaaatccagcttttatctgacaggctgtttaaagaagtttgacatctggcttctttacattgctggaacttaactattcaagtagtcagtgtccagcacacctttttttcatgcaaatttccgtgtcgaaactacaaacggatatttgatcaaaggtcagctctcctttgtcttcttgttcgataaagaaatttctatttcatctttggctttcaggctagtttggaaaagtgttgtctgacagaaattactgatgcatttcttccttgtcctctaaagtttttccaccttcttcctttttcttcttttaaatcttcaggggctttaaattagaatgttttcactttttaatggaatatttaaattatctgaggaagaaacttgaactttgtctgcttgttaactgaggctgaactgctggtagatagataatatcccagcaactgatacaatatcatcaaccttttttttatcagcagttttatctcatgcttaacttgtgaaacttgtgtacagatatggctacaaaggaaggttgtcatcaaggaccaaataaggacatttttctctcctgatgctcctttttctttctgaaaagaataaggacaggagcaacaaagaaattcctaaattagtttgtataaatatacgattattccacagttagttgactcccattgaaaatccaagttgaatttaagaaaagtcaattgttgactgagtatattttcaggtatgaaatgctataaaatgggtaaagctccatctgaattttcatcagaactgtcttagctagttgtagattgtatagagccttgaaaaattcagtaagatgttaaagctcagctattggaaaatatattgcaaatggaacactgtaataattgtgtttaaagagacagtactcctgattataacaccaaacttccactagacaaagaagaaattgtcaagtgaagatctgctgaactatagaactagactacttcactgcttaataaaagggacactgaccactagaagaaagacactttgaaagcagacagactgggtttgaaccctagccctcccacttcctaggtatttgacctcgtataagttttctgagacccaacttatgtatctataaaatgaggataattaaaattccttacttaggcatactcaatagatgctactttttcttttttcttttatgtataataggtactcatatatagtaaatacatataataaataaattaaacgtagaaataatactacaagaaaggcaggtaatatctttttctttttcgcccacgaatagccccacagctaggaagtgagtgaaggatctgtacgcagaccttctctctccccaagttctgagctctttcctctattttcttaatggaaaatctaacaaaaggacagaaaatgtaacagaattcatatgtaatgaagaatctgaaactcttctccaacaaaatatctccttccacttatcccacctccatcctaaaagttttaccaatttagttagcattttaggaagcaagctgttactagtctggtctgatctagaaagtcagattcttgcacaccagtgagaatatttgcttccctttaagtaaactggaatggctctttggatgttctctttgcttaactcatgcttatactttatcctcaggattggaaaacactctgcttaccatctaaatgtaccaccagctacattttaaaatagatctatgatgtcctcttagtgggcacgtccagggagaatctacatgtccatgatatccctgagccatgtggttcatcccaggtcagggtgtcatgcaaagacataacagactcatgacccaaggaaatacagtgaactcaaaccccttgttcatatatgtgaaagctcaggaatataggagaggctcagtaatactacacagcctcccttcaattccttgtcccttctgcttaccttgccccatcctccccctgcagtcccttgtcctccctcctcccctagaatatcaggcttttccctccccaaatgtcccctctatccctttctctggccctttatgatgtagatttacaaggcattctttccctatttagagaggctttctccctggagtgggtaagaagagaaaaaaaaacccctataattctgggattctcttctgtgaggtgaagagaagagggggctgggcaaaagctaaattcccaatcaatcacacaagattgacatgagcctctctgcactgttgtatgcccttgttttgtgggcaaaagggaaaattgttatacagggaagtagtttaggatagagaggtacctctgagcaatcacgagttaataaggtcacaggtggggagaattaggcaattcacctgtggtctgatgtttagggagaaattaatcaagttcctgaagtaatagggtcagcagaaacatatagttaatggtcttgcccagctggtcatctttcttttcttgatgcccctcccctagtgaaccaaggttcattttgaatccaaatttttcaaacctcaaagccatcttccccaacatgtggtttcacaacagtcaacatctactgtcagggaaagaacagcattctggtggtgaaacaaaacagcacttcaactccttttttaaaaattaataataataataatttaggacaataagcttatgtcgggaggtagtgtggtcatcaaaatagcctaagacatctggatgtggtcccctaattaatgccatcaatgtcactggtaggcattcaaatgatctggtgctactttcagggtgttcatgatctttcttcccttttttaaaaaaaaatcagaagagtctggttgcacctgcagttgcttgcatgctttctagctaatggctttcagtgaccctgtgcctgataggcaatggtctgaaagggaacacctcttggaaccccaaatcctgcatcccacaagtacatgcaagtgaaaatcaagcatcactttttgaacaatagctgactgtgaatttgataaatagcagggtgttatccactgcttcctgcactgcatatgtgttgtatttggttgtcagataagctaaatacctctaataggatctcctcccgcttttagtaacagctttattgaggtgtaattcacatactatgcaattcatctgtttgaagtgtacagttcagtggtgtttagcatatacatacagttacaggtgtgcaactaacaccataatcaattttggaatactttcataaccccaaaatgaaaccctatacccattagcagtcactttccattttcccctcactccttaagccctaggcaacctctaatttactttctgtcactacatgatacgattcttttaacttctgtttttaatgaaagaaaatctgtatctcacggtgggggtctacagtgttagtgctggggtcaagcacatagagtcagagttaaagagggttttagtgagctcagtaagcgcttagcatctcaggagacagacccagatttaagtcctggctctgcactagctagctgtgtgttttcagatgatttactctcaatctattttctcaactacaaagtgggaataataataattcatgcttcatgggcttgttttgaagattaaataagaatgcatgtaaagcacttagtatcattcctagactattataagtgctcattacatgttaattaatgttaccatatttattactgtcattcacaaagctctctgcagaatacattccacaatattgaataacttgcctgccacagcttggcagttctactttacttcttctaaggtaactggaattgtaacttaacaggtcaatcacaagaatggcttcagaggcaaaggatgccagaccacagtgggtgatggagtgaatgagcactgaaggcagtgagtgcaggctcctctttcaagaaactgggctgtgacttcatggagaaggtctctgtaggacacagagagtttgcagatgtttgtagactaccagggaaggaaccaataaaaggaatgaaattggagataccatagataaggacaagtaaagggacaagaccatactgtaatggatatattatatgaataactgcgcaggcatttctcaaagacacagcaaagaaaataaaaaaaaaaaacagtgtcttatcttgggttcctctgaaagcagagcctgagatgaaggctggattccatgtagtttatttgggaatgtgatcccagaaagcagaagtacaggatagcaggagagaaacaggaaggaaggaaagtttatacaaggtgttggcctcatctgtaggtaattggtgcttaataccactggaccttctgagaacctcataaaacccacttcagaactgcctatctactggcacaaggggagacatttgtcttttgtctccttttccactaggtcaaagatggtctattggattaaatcctttgtatttctagcatgagaaactgtgagtgccaagccggttcccgagggtatcccatgctgtggcttctacagagccacaagactgaaagcaaaaggtacagggctctggcccaagtggaaggctgtgcaagtgtacctgggtaaagcctactgaagccttcagtaggatcgtcaccaagtggtggttgggttgagaggtaggccccagaagattttacagtggtggacaacagatactccacaggaagagctaacattattgcacattgattaaacaccgggcactgttctgaacacttgacattaattcacttaatcctcacagctactttgcattgcaaatgagaaaattgaggcacaaaagctggagaacgctgcttgaggtcacatagctgttgagtgtcaaagccaggaatcaggttccggcacacaagctcctaacgactgcaccgcacagcctctgagaatggggctggctgaagcaggggcagcagtgtttgtgttgtgtccatgttggtggggaccccactcattcacatttgacctccggccccctcccctcagcattccataaatgccctctactaagctctaggtggaattaattcctatctagaccttccaaggtcatatttaacttaactccactcactttattccccaaagtaaaacaaaacccaacttgctgactgcaagtgaacttggagcctcccctcctttttttttttttttttttgagaaggagtctcacactgttgcccgggctggagtgcagtggcgcaacctcggctcactgcagcctctgcctccccggttcaagtgattcttctgcctcagcctcccaagtagttggaatgacaggcgcctgccaccatgcccagctaattttttgtatttttagtagagatggggtttcactatgttggccaggctggtctcaaactcctgacttcgtgatctgcctgcctcagcctcccaaagtgctgggattacaggagtgagccaccgtgcccagctggagcctcctttgagctgcttggtctcttgctcatttattcttcactaaaattcaattgaaatcatttggtgatcaccactaagagtcacttccaaagtatgtgttgttaaaagaaaaacttcagccaaattacatttaaaggagtttaattgagcaatgattgatttgtgaatcgggcagcccccagaatcacagcagattcagagagactccagggatgcctcgtggtcagaacaaatttacagacaagaaaaacggaagtgacgaacagaaattggaggtgaggtacagaaacagctggattggttacagcttaggatttgccttatttgatcacagtttgaacactcagcagtgtatgagtggttgaagtacggctgctgggattggccaagactcagcaattgttagaggagcatactgataagttagagtttcaatcttgtctatctattaagttaggttgcagtttgtccacaaggactcaaacatagaagtacggaggccatgtttagtttgttttaacagtgtaataaaattgacttaaactacaaaagaactgaaatattcaactgcacctaggacaaaaattttttttaaaaaatgtaaccatagctacatttgactgtcgagcgctttgcaagtggtcaaactgaggtgtgctataagtgtaagatacattgcaaatttgaaagatttagtacagaaaaaaagtaaactacctcattagtatttcttatattggctacatattcatatgacaaccattttggatatattgggttaaataaaatgtgttattaaaattaatgtcactgatttctttttactttttaaaatgtggctactagaaagtttaaaattgtatatgtgactcatagtatatgtctattggacataatttgaccttttccagcctcattcttactttcccagtcactacacttcagttaccaactttactcttcctaaaacagccccaacgtgttcctaacacagggcctttgcagttgctcttcctctgccaggaatgtcctttctcaggattatttattcctttccttcttgatctcttcagaggaacatcccctatccaatctatgtagacagtgtctctatctttcttgtgctttatttttctttggagcagttaaattggggacgggtggagtggtgcacatttgtcatcagaggctgaggctggaggattgcttgagcccaggggttcgaggctgcagtgagctaaggtttaaacaaactaacaaaaaacaaactggtatcatgtcctctgtctctgtcaatgccctctttatattatagtggaaataaatgaagagatgaatggagtagatttttgtgttttcctgtaaccaaccttttgggtaatgaatgaataaccaattagaaaaaaaaaaaaaaagtccactttgatggactgtttcatctcttggccttggaatttcaaaacctgccttagcacctccacattgggactgcatctggcagctaagttgaggattcgcttgcagcttaaggatcctttcaagggccttctccctaggaagggatgttgacttgtctagccttcctgggagctgggactccaattgtctcatgcacagatgctgaagtcagttctgtttgtggcttctgtttttattgacagtagagggcagcagagtcctttccacaggagcatttgagccgagaagaccaactaagactttgggctgtgcacagttaaagtcaagctcctttcagagagaaatagctaacgagacccgtaatgtctagggtaagaactatagcaatggcatattttcttctatctctaattatatagatggttcaaacttctgatgcaatctccttattaaatatttattttatctgagtttttattttcttgcctccgttttgtttgtagtttaagggttggctagggggtgtaggactggagaaagttgatattagtggattcatttacattcatttggtttacatctcatcctggattttcaggaatgaaaactggcttcttgtggcatacaatttctgtatttatctgcaaagattactctggagggcagacagtgttggctctaactttatgcatgacccagaaataagcatctccattaacccattatcattatagcactgagagttttcaacaaaacatatgcatgagaattgattaataatccctaagagtgatgtggataataaaaagcttataggtccctcagctatgacagacagtcgtgcagatatgcttcctaagaacacaaggaaaaaaggtatgattctccaaaaaagtatttttaaaatccagtaggtagtgagagtgcttctaagaaattatacaaagtgccttgatcagttagtaactttagaatgagctcttagctagaaaattcaggaaatcagcagcataagggtgttttacatacttcattaaaaaaaatttccaatatatttaccaaaaaagaaatcatgattatttcctcatctccatatttcacggacaatagaatggtttaggttaaaacaacaacaacagctgaccttggcatgttggtcaagttagctagcagctagtgactcaaagtttcccctattagctgtactgtctcagtaacagagttttgaattgcaacttaatttctcctaatattgtgtcctacagttttgatacctaatagttgcatggatatctgctatcattctttggttgctttagttgtgaggactgttacattctctaaaaattctgttttagcctccaaatgcttagagccagaggagtgggatgaatttgctaacccataatcacagttagtatattgatagccactggaagattttgttgctgtttatggccacacaaatcagtctcaggctggattgtttgggctttgtttgaatttgctacttaactttgaactctaggttttgaaaatttccactcagttgcaggcatataaccttaggaaattggattctcaagagatagctgaagatagtgttgagcatgccgtttagatacaaaataggactaaagagcctcatcctgctgaaattatttaccattggagcctctgaatataaatgtactcctaaaggcagtgaagcttcaggaagccatatgaaggtgaataagaaaagatttctattattatacatatgggacgctgagaaagagatgagaaaagaaccacaaggaaaacataaaatggatgtaagatcgacattgcattttgaatatatgaagatattgtcagaggaaaattctattttcacgtacgataattctatgcaacacacataaaccaacaaattcttattcaaaagcctaatccaggtttaagaagtgggaaaacaatctttgcattttgaatctgtccttgtagtgagaaagagctgaattatgatttgaactcttactgatagataggaactcagaaactgcacagaacatttgaagtatgtatttgataaaaattcagtgagccctcttttgtgccaagtacggtactagatactatcgatacggacagagtttaggacatgccattccaaaatatggcctcttgatgtttcagaaaaaagcagaagcaggaagttctctttgacctcctcccaaagttctcctctgaagcaggtcgtaaaagaattatctgatctttctttaaagtaggtcataagaccctcattccagagacatctttcctgtatctggaggaaggaatgaagacatagagatgccaagaagaatctgaacaaataggccttacaagttgcccccagttaattccgattagatcatacctttgtccaatcatacttctgtatggctgtctactcttcattaaacctaagtataaaaatacacaagttttcctgtttctttggttcttcatttctgaaaactctcacgtcatataaaacttgctcatatgtatttttttttttttttgtagaagtctcagccatgaacctagcagtgaaggaggaaaacatcttatgtcttgttctctacaacacaaagatgaacataaagaagaaacacagactctggcctggagaagttcagtgtctggtgggggagactggataaataatttaaaacatttatttaacaaataattacagtgcaatatgataagtacaatagctaaagtgtgggcaaagtgtcgcaggaacaggaataaagaggagacaacttccaaaaaaatcttacatacttaaccttttcccgacattttgacctgaaaataaatcagcataacaactcacaaatacaagggttacataatttgctttataagaagtacagattagttttaagtaagatgatttctttataatgatagccctgataatttagtttttatggacttttgggattccatatttattaagtcatcatttgagtctctcttagtagataggattctcatcacacttattttgggggatgtcatcttacttatttgccacctaacactggtcatgggctggtattcaacaaaaatttttgagctaaattaaatttgaatatgttattatgggttagatgaagtaaaaaaaaattggggctgttaattggtaaaatctgaattaggatatttatctggataaagtactaagaaaaaggaaacctttacatatctcctttatatagttaactcccaacactctacactaaatatactgtttagtattaaaggctaaacttataatttctatcatttaatatagatataattatctattatatagatatctagatatctagatatcatatctagatatctagatatctatatcatatctagatatctatatcatatctagatatctatatcatatctagatatagataatatagatatctatatcatatctatatatagataatatagatatctatatcatttaatatagataatttgtttttggcagaaaatatatatcagataactacaagcagaaaattctatttgatacaagaaatgaatttggcatttgctcaagatacacacacacacacacacacacagatatgagtataagcaaggactaaattacaaagcatgaatttatctagaatactgtggtctcaggtatgaaggaagtctttaaagtgccctatctaaaggatcagcatgcagatggggaatttattttggatggtaatggtggccttcccttggaactctttcctcaaatcacagctcatagatagccaattaggtcaaattgaggtttgagctttccaaatggttctctgtttttcctaagcagcacctcttagaccaagagttctccatgaaaggagttacctgaaccgccatgtaaccactggcttttccatgctcaaagccatctgctcatgataatcacagcacattgtgttttcatgaagtactttcacaaggtgttatctcatatgacatgaatagcttcatcgccaggttgttaaatatccacttttcagatacagaactggcttataacttctattcaacatagtattggaagttctagccagaacaattaggcaagagaaagacataaaacgcatccaaattagaagggaagaagttacattgtccctgttttcagaaaacaggattttatatgtaaaaaaacccctaaagactccacaaaaaactattagaactaataaatgaattcagtaaagttgcaggatgcaaaaccaacatatgaaaatcagtcgtatttctatatgctaataactaacatccaaaatataaatcaagaaaacaatattttttgtggaataactacaaaaagatacttaggaataaatttagccaaggatgtgaaagacctgtgcactgaaaactataaaacattcaggaaggaaattgaaaaagacacaaataaatggaaagataccctgtgtttatggactagaagaattaacattgttaaaatgttcatattccccaaatgacttatggatttaatgcaatccctatcaaaatttcaatgacatttttcgcagacacagaaaaaaattctaacttttatagggaaccacaaaagactctgaacagccaaagcaattgtgagcaaaaacaacacagctggagacatcacattatctgacttcgaaaaatactataaagctataataaacaaaacatcatggtactggcataaaaacagatacatagaccaatcatacatgagcccagaaataaatgatttttgacaaaggtgccaagaacatgtaatggggaaagaacagtctcttcaataaatggtatttggacaactggatatccacatgcatgcaaaagacaaaaattggacccttatttcatacgttatacaacaatcaactaaaagttgataggagacttaaatgtaaaacatgaaactagaaaactaccaaaaaataggagaaaagctttgtgactttggactgggcatgatttgtttgtatatgaccacaatcacaggcaacaaaagcatacatgaggttacatcaaactagaaatcttctgcacagtcagggaaacaatcaacagagtgaagagacaacctatagaaagggagaaactattttaatatcatacatctgataaggggttaatatccaaaatatataaagacttacacataaattcgatagtaagaaaacaagtaacctgattttaagctaggcaaaggatctgaatagatgtttctcaaaagacacacaaatgaccaacaggtatatgaaaaaatgcttaatatcactaatcatctgctaaatgcaaattaaagccaaaatgaaatatcacatcacacctgttagaatggttattaacaataagacaaaacataacaaatattggtgaggacgtggagaaaagggaatgcttgcatactcttggtaggaatgtaaattagtacagggattatggaaaacagcatgaaggttactaaaaaaattataaatagaactatcacatgatctggcaatcccactactgacaacatatacaaaggaaatgaaatcagtacgtcaaagagatacctgcactcccatttttattgcagcactattcacaaatgctaagatatggaatcaatctaagtgtccatcagtggataaatggacttaaaagtgtggtatatacaatttacaattgtaaaagtatggaatcagcccaaatgcccctcagtcaatgagtggataaagaaaatgtggtacatatatactatggaatactactcagccatgaaaaggattgaaataatgtcattcacagcgacctggatagagttagaaaccattattctaagtgaggtaactcagaaatggaaaatcaaacatatcttctcattcaaaagtgggagctaagctatgaggacgcaaaggcacaaaaatgatacaacggactttggggacttgggggaaagggtgggaagtgggtgagggatgaaagactatacactggatgcagtgtacactgctcaagtcatgggtgcatcaaaacctcagaaatcaccaccaaagaatctatgcatgtagccaaacaccacctgttcccctcaaactattgaaatataaaataaattttaaaagtttaaaaaatgtggtatatattcacaatggagtactatttggccttaaaaaattaggaaatcctgtcatttgcaacaacatggatgaacctggaggacattgtgttaggtgaaataagccaggcgcagaaagacaaatattgtgtaatttcactcatgtggaaccttaaaaagttgaactcgtagatttatagaagaatggtttttactggaggctgggggaagtggggagagggttgggagatgttgattaaaggatacaaagcttctgttaagaggaaaaaattcaagaggtctattgaacaacgtgatgattatattttataacaacacatttgttattcttgaaaattgctaaaagtgtagattttaagtgttctcacctccaaaaaaataagtatgtgaggtaatgcatatgttaattagctctattgaggcgttccactatatatatatatacttcaaaataatgtgctatacacaatagatttacataatttttatttgtcaaagaaattaaaaaatagaaccagtttatagaagttacaagaaatgaggacacgacaatgagcacaaacatagatcttccattaactagtgacttgtaatatttcccatctaggcacagtattttctcatgcttgagaaggtgcggtttattttgtgaccccatcatttgtgaatgctttaagttgctaactacagtggcaatcatcacctatccagatcgggcaccactaaaaataactgccaatgaatgtattattggcaggatttgagaacgcttctgttctcaaattctgaaatgtttaaaaagctcctactattcagaagacatattattcaaagcacagggtaccaaaaacaaaacaaaacaacaacaacaacaacaaaaaagaaaaatcccaaaactgtaaccacagaataagtctctgctttaaaaaaatatacaatttacttgcagagacaaatgatatacacaaaaatttaaccagtgtttggaaccatttttaatatgtaccaatgatagactagaacttcagctttaaaggaccggcatttttgccttcccacaaagacagcagtattttgtcattgctgtatcctcagctcctctaacactggcaggtatatatttagtgcacaataaaatttttttctgaatgaatgagcagcacatgctataggtatgatgggattcagagggagggacttgtgtgaatggagcagtcctcaaagatcccacggagggggtgagatgggaactaagccttcaagtagatacagtattggtagacttattaaatttagtgccttattaattcattgtctactatatgccaggtatggctaaaaggggagtgcaaaaaccaaatcaatcaccgacctaaaatgatcatgggaatttaacatgtgctctaaaactcagccctgtctgcccagtatttcctataattcaaaacatgtatagcaaaataaaaccagagtgaaataattaagaaatagtcactaatctgaaaacatatagtatagcggcaaaaaaaggagagcatccaatattctttttcttgcctgctatttcctttcatttctctctaaacatagttcaaaagtcctggcaaggagtgcaaattcagatggatagaaatgctgcccctttgtcactgcggaaggggtcccttcccctttgtctttcagcctggaggctgatggcacattaggcatggtcctctgtctcatgcaggcctcactgcttccctctcttccaaccactttctagcccccaccccaaagtcaacaagcagcaacacaggcatgcatgggctgtgtatctgagttcctagaagatcagctctggtttgttcttaaatcatttctcttgcaaatctggaaattacacaagtgtctgtaggctttggggagtaagtggagaccagaaaaatatagacactggaaggagctctaaaatccctctgctacccactccccaaataggtcaaccagatgcaagatgccatatctttggtgtcaggaatctctcgccatttttactgttctaggaagttaagtgttgaagcaattcagcagattatttttccatgttgctagacttgtgtttgggaaaaaaaagtaaaaggaaaatacatattaaaatataaagacatacatatttatatgtgtatatatgtatatatatatataatgatatacatatacatctgttgcttacattgtctctattgtttggctttccttggcaacacagtgaattcggaagactgcatggcgcactgttgaggccctgagcttcagagtccaacagatcttagtttaatccaagtttccttgtgtactgccagtggttaaaccatctatgttccttcctacatatcaggaggccaaaacatgccacatagtactgttatgacaattagctgggattatccaatgtgctcagcagagtccctgaggcagtgtgaatattaataaaatttatattggaaccacttttaatatgtaccaatgatagactagaacttcagctttaaaggacaggcatttttgccctcctacaaaatacagcagtggtttgtcattgctgtatcctcagctcctcgaacagtggcaggtatgtatttggtgcacaatatttattctcctttgtttctcaatcttaagcctgacctcaaattaatcaccttagtctggctttctctgttgtttatccttctatttatttatgccaaacaccttaaagcaggctttctcagctcagcactattgacattttgggcaggacagttccctgttgtgaggggtgttctgtgccttctggtctctttagtagcatccctggcctctgcccaccagatgccagtagcagactgctcccttccctgactgtgacaatccaaactgtctctaagatgttgacatgtgtgccgtggggtgcaaaatcacctctgtcttggagtcattcttgactcctctctgttttgcactcttccacctaatccatcaacacaccctgttcacttactttgaggatgactctctcttcacagctaccaccttaatcgaagccaccaacatttcttttcagtattactgcatgggtctccttgctggtctcctaatcccctagcctcacctgcaccctccatcacctccagcctcattggcctccttgcagctcctgaaacacagtggaaggctcccacctttgcagtgctgttccttctgtgtgaacccctctctctgccatcaccttcatgcctcactccctcactttcagacctctgctcaatgtcgcctttgaggtggggccttcctgaccaccccaaattctggcaactctggatcttccttcccttccactttctgcttcattttctccatagcactttcttccattgaatatagtttattctactcattttgtttgtcttatttcactagaatgtcgacttcatgaaggtaaggtttttttgtatattgagtttttgctagtgctccccaacagcagaacagtgtttggcacttagtgggcactaaaagatttgtcaaatgaatgaatacatgtattatcatcattttttaaaatgtcaaaattgtggtaaattatacatgacataaagttcaccatcttcgacacttgtttaagtatacagttcagtagaaataggtacattcacactgttgtgcaaccagtctccagaactcttctgattctgtgaaactgaaactctatacccattaagcgcaactcccattctcaccttcttggcccctgctcctctgctttctgtctttatgagtttgactactccaggtacctcatgtaagtggaatcataactgtatttgtctttgtgtgtctggcttatttcacttagcataatgtcctcagggttcatccatgttgtagtatgtgccaggatttccttcctttttaagctgaatgatattccattgtatgcatatactgcattttgtttatccatttgtttgtcagtggatggaagtgaaattgctggatcatatggtaaatctatttttaatcttttgaggaaccgtcatttctgttttccatagcagctgcaacattttatatttccaccaacagtgcacaagggttccaatttttctacatccttgcaaacacttgttcttttatttatttttgatagtagacatcttactgggtgtgaggtggtatctcattgtggggctgatttgcattttttaggtgatcaatgatgctaagcatctttccatgtgtctcatcactgtttttaacatctaggtccctcttcttctcaagggtttgtggcttgtccaagcagtgtcatctaaatctccatctttcatacctgctgcccaatccactctattcccttttgggactttgtacatctgtctcggtcttttctcagtgagcctttcctggttaatgagggagaaggctagtttttctcatttaagaacacactagaagcctgtggttcaaagtccatttttgtccttctctcacagacatcaatctttatcttctacgggcaattatctcacatgagttacaagagtaaacaattaaacattcaaattagcacatttgctgctatgacttccagaagctctctgagcagatgatttagtcagttgactcacttatataaattccaatacaacacttgtcaatcagatgtttaacctgagaatgaagtttctttcatctctctttcctttttctcgcctctttttgatcttgcagcatctcaactttgaggagttatttggagtcactggatatactttaaccgtatcttgtacatattatccatggtaattagtaaagtccttttaaaaaatctggaacatgtttatttgtgtcactagaaacctagcatggataaagaactaataaaggaatttcatattgtcatgttaatttttttccccttagtattgatgatttcctcttacaaactccaaaatgcttccttcaaaaaatattaacttgtgtacacaaagttctacactgatctgcctgtgagagcccattccagtcaacacttgctctctcctcactatggccttgaggttgtgttgcacccatgacctgaggatgactatgctgtggtatgacaatagaaatgtgtatgtcctaagtttcaaggacaccaggtgactggagtccagatagtagatatatagtcatctttgcttttttttttttctatcttcctttttttctaacttctgtaattcccttttgcgtttccctataaactccaggttttaaaaaattctacctggcagacagctccttcctcatctcatttatgatttcttctccctcttttagtctttaaacatgggcactcttcagttctcattgctgtgtctcctgctttttctctttcttgtcaggcccattcatttcaactctgtttgcacgtctctgcataagacccaaatccatgccactgaccatggcctttcctgagcttgagacaggcacccctggtcccagccagcattctgtcaaagtaaacacatcaacctaaacccagtccttccttcacacctcctttttgcttattgacttaaccatctgacatatctcggtttgcaaaactcaaatatcatttccactttcattttgctgtcaacagaaagtaggcagtacttaaagaaggaaaatatttgaagatttaaaacatttaaaggaaggaaagattgtttgggactagggaccaagggaaggtcccaaggaagaagtggcattgggctggctcggctttaaagcatatggagaagattgagtaaggcacagatgaggggtggaagagagtttttcagacaaaggctatgttttgcgaagaggagagttatttgcagtggctagaaaggattgcagagagaaagaggagtttaaggtaaaaatgatggagaatcaagagtttattgtaaggagttggacttgaagtgagaatccctgagaacccagtaaagactttctaggagggtgtcttagtccattcaggctgctttaagagaatgccatagactgggtggttcataaacaacatgaagttatttctcacagttctggagcctgcaaagcccatgatcaaagcactggcagatttggtgtctggtaaaatcctgcttcctagatggccatcttcttgcccatgtgatagaaggggcaagataaccctctgggatcttttttctataagttactaatcccattcacaaggcctctatccttatgacataacaacctctcaaagggcccatctccaaatatcatcacattggggcttaggtttcaacatactaattttaaggggaaaacaaacattcagtctatagcataagggcaacatcatttgaactcgtaatttctgtcatgcatcccatgtctgatttcccctggtaaactttaaagtctttgggtaaaagtgtacacttaacattctagctttttctctaattcttctctgaacccctcagcatgttgctgagcacactggaattcagtgtttgatgactagatgaacaagatagtaatttaagtataatggtagaatgaacacaaacaaactaatataaaaatacatgttccattagtatatgaacttctgaagcttttaggcttcccatataactatccaattccttatttacccagcctccctcctctctcttgcgtgtatcagatactttggatataaaagaggaaagtctcaagaaattgcctgtgggaaccagaatgacatgtaaacaaattctgaaatacattacaaagagtgctataagagacaaatgtctagcattacatggaaacacactaaaaaggacagctagatacctggattgacatctgagccagatagaccattcattcaaaaattatttcctaggtgcaaggagctgatggtatcctgtgtgggatatacatactcagtcaggacccctactcctaagacctcttggtctaactgatagcaaaatactctcatttattcagctgctactatatctcatggactctcacagaaagcttttatacagacaaagaaactcagagtcagagaagataggtggcttgctcgaaaggatttgggttagttgcaaaactcatgctttcttcactacacaatgcctcttagaaacagcaaatggaaggatatacaaagtgttattagtacttagaagcagggttaactagagagggtcagggaagtctttctgaaagagatggggttttatagcagaagagcaacaggatgactgtcacttgttctttggtctaataaacacattttgataacaagagctagtggtagaatgttttaaaaagagttgggggtctttgttacccaggccggtctcaaactcttggtctcaagcaatctttcagcctcagcctccaagtttctgggattactggtacaagttaccatgcccagcatctagtgatagaatatttttcaccaattctgccatgaccttgaagaaacacaaaggtacaattttactattgtgttctatttggatacctgaggttgtatgtagacgtgatttaggggtgacatttccagaagagtttatttgccccaacaaaagtctgttgcctgaggccccttctctgctaacaataacaaaaaggtttgggactcaaagttcactatactttgttacagaaaacaaagccagggcactagggaagacaggctcatcttttttcctctcccaagcatcactcaactgatatacatcaatatatttgcactgggtttgtgatcagacatttgagcctttatgtataaaaggcaagtcacaatatccctagcctgaataattcatgttgtttttcatgggtcttttaagcctttttgttaaacttgaagattagctttttctttttcttttttacttccttaatcaaaggttatttggagtcaactttgaacaattcctcaagctgtactgttcaaccatttgattcagtattttcaggatttggaagcaggttgctgctggttcttaggtctgctgtattattcaacgctttagtaaatgatgaataggctgaaagccatgaaggctattttataatttctcaagggtctctttaccacctaattttcttttcatcaaatgttatttactgagtacctccaatcaacttctttggtattgtagcttgctgtgattctggcagataataaatgtcagcatggggagggtaaaagaaccaagccttacatttaataatattgtttgttagaaattggcttcactttcatcatagagagtctcacagggggcaaaacctttactctgccatcttgataagatccctggggtccctctgtgggtctccctaggattttccacgtgtacaagagatgaaaaggtttttaagatctaagaaacaaagcaatctattatttatcttgaaaatcatattatgtcttgtgttgtataggcacagtaggcatagtaatgtgcagtctatcaaagacacaagaacaaagatgttaaattgatatcatatagcacctagcaggaaagaatcatttctacttggaaggtagggagatgaaagtgggaagttagagaggacaaacatgtggaaggcaaatcatagccctctctacaccacaggaatgtttacacatcagaccaagcactctcgtgttgagctcagatgcagctcaggatccttctcaacacagtccactgggaagccattgtcaatctcaagttgccatgccagaggaaaattttattcatttctgatgtcttgggtgatttgtatccaatgcagggataattatgggctgatccaagaggccactctagagatattccctattaaaccctgtatttaaaaaatctaataagatgggaggtgttcttgtaattatttcatcatcgtagtatgccatgttttctgttgcagtggagttttcatgacagctcagtgttagtattttatcccgttaattgcaagtttactgcattgtcagctagtttatttcattaatagctgttttatctcattagtagtaggctcccatctgctttgaagcctttgactaagatctctgtgttgtctctcctgactttcagtagtgcatccctgacctctcctctccagagtttctaaattttgaataagctctaatttgcctcaaatctttcatacctgaaatacaaagagtggtttctgtttctctgtctgaactccaggcaaaaaagagatgttatattttatagtcaaagcagtgcaaatgtttttctattttgagctctaaatatagtagctttttcatccacatgttcctttctctgtgtccctaagcaggaaatttcatgctgtttatatattatgctaaacactagttgtttcacctgtgtttagttatatccacaaaggaaggttttttatctctttgagagttgaagactaggcagtattcctattttccttctgacattgtggctttaaaaatttttgaacagccaattgagagaaaaccacaacttatttcaaattagtgctataaaatatttctgtcattcaagttaatgatagcaaaggtcaactttacggcctcactcaaaaaggagtgtaatggagatatagacatacacattaccttcagcactatgggtttcttctatttgccccctgaaaataagtaagtatgccagcttgtctattgccaacttggccttaccaccagccttctaaggtctcttccactttgcggaggagatgttagggactacattcctgaatccgctgtcctgtatgtgtaattctggcttagagttggccaagaagaagcacgtgtgtaagatctggatgatgaaagagaaggagaagcctttattcccttgaggtagttgcagccagacatgtgggcagagatttcacagcaggctcctggtgagcccatgagaaacgtgctttatgaatgcagacagagagagttggtgggaattttccagagactttgaagaatggcagtaggctctgggcaagctctccaggaacacctgcctcaaagctttcagcagagatctctttgtgccatccccaaccttaactttcccagagcttcatttgtataaacctctcctatcttaactttgtcacacctgaaataaagagcagtggttctgtccctgcctgaacactgcctgatatgataagtaaatgaataaatgaatgagtgcccagaatacccattatagcattattctagagtattcatcatagtatcaaagcaattgacacagacatttgctgctgaccaaatgtttgtgactttcccatatatcctatcctcccttctagttggttgaggtcatgtgactacttcaggccactgggcctattaaaagcagcaatgagcagctccaaggcatttaaaatgcttcttgtgctacctccacactctatgaccctttgtagaggtcctgtgttatcatggcacagctacaagatggtagagcttccagaagcctgggcctttgcatgctatagcagagctaccttgctgatctatgctgaacaagtaacatgaacaagaaacaaaactttgttgtatgaaagctgtgggagtttggttcaacttgtctccatagctgatactagcccaatccgacaattttgagagtataagatctactttttaaggtgcaatagacaggattccctagtttgaaactacaaatgcactttctgaatgaaatgtattattaaaagtaccctgccgatattgtctcaaattcacataaatatgttacaaaaagagtaagaagaaaataagtagtgtgtcaatacatatatatatgtaaagtgcttcatttttaagaactacaaaatgactaataaatggacaaaaggcaaaattataattcacacagtgagaatataaattccagacaaacgagaaaaagtattctcatttattagtaataaatatgctaaccgaatcaaggtatcactttaaagttatgagattatcagttaaattattcatgttaaaaggatactacctcaagatggttgggttataggaaaacttctttgcctatattttgggagaggcatataaacatgtgtgtttagaaagaaatttgacagaaaaggtgacgtagaaatggtcataatctttgccctaatcattctactctaaagaataattgaaaagtggaagaaagccccatatatatgaacaattttattgccaacattgtatgtaacataaaaagggaatgtaatgtcaaaatgtaatgtaaaaaacatacatatttagataactatgattttaactatgattaaaaacatacatatttagataacttttgcaatgttacatagctattaaaaagttattataaagcaggttctcaacttgagtgtgcatcagaatcacctggagagcttataaaaacacagcttactcagcccaagtccaagttcttgattcagtaggtctggaatgggaatctagaatttgcatttctgacaatttccaggtaatgctggtccaaggaccacactttgagaactcctggcatcaaggattgcaaaatattagttaacatatataatacagcattaagtaagaaaaagaaacattgaaatcataagctaagatacacttactcaatagtgcaaagagatattttagtgaaatcatggttaaaagcatggggtaaggaagacagtcagactcattggaattccagctttaaagctatcatgggcccaaagctctagagtttctacaaactcttcagggatctctgaaaaggcttgagacctgaaagagaaagaaaaggagtagcaaaatatacagagaaaactgtaacataggaattagtaagtatttaattaagcattccaaaaacataacactgggcatattagacaattgaaagacagctcttaattatatgtacatgtttatagagatgtttgtgcaactaaatatatttcctataatgtagcatggggcctctaaaagtaagcaaattggtgtgtgtgtgtgtgtgtgtgtgtgtgtgtgtgtggtgacgggtcagtagtatttatacaccaatctcaaccaggtctaacactaatcaataacaaaggaagaatccagtgttaccttcatcttaccgctgtccatcaataggcttcactcaccccatctccaactaactgatgttagttactctattgtagggtctactctccacacaacagtcacaggagattaaatatgatatatcacccattaaaattctccaataacttcctccagaaattcaaactccataagtacaatgatcacacagcctggtttgccagaatcaaatccaggcaaagccactgtcctagatgagctgtcaacaacacacccttcactgagaagtgttccactttggatgataagaataagaacagaagggaaactgtcattctcagcaaactgacacacgaacagaaaaccaaacaccgcatgttctcattcataagtgggagctgaacaatgagaacacatggacacagggaggggaacatcacacaccggggcctgtcaggcggtgggaggctaggggaggaacagcattaggagaaacacctaatgtagatgatgggttgatgggtgcagcaaaccaccacggcacatgtatacctatgtaacaaacctgcgtgttctgcatgtgtatcccagaatttaaagtataataattttaaaaaaagaatagaattgccagatccaataccaaataccaagtattgctgtagaaatacttacactaaatttttttcattgttgatctgaaattcaattttcacaaggtatcccatatcgttatttgctaaatctggcaaccctattgcccctacataaagagccctaaacgttacgcccctgcctaccaccttgctgcagtcaccgctcctactccctcctgctccagccccagtgtaattcacatgccttgaacatccatgctcattccctcctctggaccgtggcactgctctttgatctccctggattactcattgtagcttcactcagctgactccttctgatcaactaggtctcagcagatgtcaatgcagaaagacattgtctgattacccagcaaaaaaagcctcatactcttccctcttttgtcactatctaaaacagggtgtccaatcttttggctttcttgggccacattagaaaaggaagaattttcttgggctgtatataaaaaacactaatgatagctggcaagctaaaaagaattgcaaataaaaatttcataatgttttaagaaactttatgaatttgtgttgggatgcattcaaagctgttctgggctgcatgcgggccgtgagttggacaagctggatctaaaataatagcctttaatctcatggctgtctttctctccccattcagatagagatgctgactgctggggtggtatatacatgcttagagcaggcttgaaacatagttaatactcaacacttaattgttgaatgttagatggaagaatacaagtgtatcaaaatacagcatcttgagttccttgtcacaggagtacacacacacatactttttccttctaagagttcacatttctttagaaagaccttagacttgaagctgagctatttccaaatgtgcagcggtagtgcatatggtaatggtttcataaagtatgttaatcaaggaaccacaaaaatcatttaatctaggaggtttcctcaccaccatcaaatactgattatatttacatagaaactgactccttatcatgcagctgataaacattgctgaagggagagcctgcagaagcctatttgccagacacaatctccaatcccaactgctcacagaaaataatcattttaaagattgccacacaaaaaggtgacattcctgtgtcattatatttcctttccctatagcagaagccaggattaataaagttaataaaaaaattaagtcaccatatgttttttaaaatgtttagaaatgtacgatgatcaacgttacaatagtaagataaggacttaaactgactatttgaggttctaaaaatccatttagggtgttaagctgttaaaaatggtttaaacttaaggtaaagaatcatgacaggattccagtttgatttgttcaagaataaccgtttagatgactttgtgtgtatcacataccgctctctaattgcatatgtaaataaaatcaaagatgcacacacttaaagtaaaatcttgcttttcaccctatgaatttaaacaaaaggtataaaatgtatatttaaacattcaagcaccatcttttgcaagtctgatttgcattcttccatgtatttaaaataagcctcctcttcattgatgttgcagatatttctatgggttacaaacagctccccatccgagctcttgtatcgacttactgttgaaactgccacataccagtgcctggacttggaaagagtttccctggtctgttccactttcagggttcaggccctctggttcaagaggtgccatgtagcatagtgggtcaggcttgctctgcactagtctcagggtagaactaattctacagccctctattgttctagagagcattttgtgttgaggagccaacctaattcatatgatgcaaaatgtagatgttatctgataagattttaagacttaggcaaaatgaatatagtgattaatttttcttccttccgatttacctctcagtttcactcagatacatgtaaaattaacaacgtaagtgataaatttaacaaatcatttgctcgttataaatatttagtttatgattatatagagaaggtttctatgagctctgacttcagttatgttaaaaactgcagtgataaaaggcccaaaataatgtactgaagatgaattcaaaaccattcagaggcaagcagggaagaacattctacaatttaatgcattgctcttctatttcaatatccactctgggataatcactggttacttcaaaaagacctttagattaaatatagggtgcagcagctgaggatctggggtattgaaaacagggtacagcatacagcacctgaggatttggggtgatcttcatttgactctggaaaatgaaatatatttttgttaacttcactctttcatcaaggcaaaccaccagctgacgttgttgacaatgactacatacacctttaggacagagactgtgtcatatacatttttattctcaagctgctcaataatgtagttacattcaattcaaggaaaatatcctgcatgttctcacatttagcagaaacaaccttgtcttcattcatctgggttctatttaatttggccggggattggggcgcaaggtagagagtattaggtggagatggggaaagagtaggtaggatccttggcagattcagctgggaaagcagctattttagaattttataaacatacaaatctcatatgtgtatatgaatttgatattaagatattctgttagaatttgctctataaaaatgtaatattgtatataaaggtaagctatataaggggaacatttttccaaaatgactaagtatattacagtcttgttttaaagccaaataatgagagcctttagttatttttatatatgaagtgacaatttaacatttatttttctagactttaatcattaatatcattaaaataacaaaagatagtcagtagaaatgtttttctttctttaaaacctctctagacttacacaaagtcctatttaatgaaaatttccaaagcttacagaaataaaaattgtcttttcatgcaatattacacattataaattttagtttttgttatgaaactatctcaaacttcttttcttaaaccatttgagaataaatcgccaacccgagacccatgaccccagattgtatttcccataaacaaggactttcttctacataattataatacatacactagaacaggcaaatgaatattgatatattactatgcaatatctaattatcagacactactcaagtttccctagttgcttcagtaatgtccttcatagtgaaaagatccagttacgaaccaaacttacatctagttgtaatgtctcttcagtttccttcagtctgggacagttctctgcagttttaaaactttcatgaccttgatacttttaagataaaaaacagttactgtgttaactcttccttaatttgtgtttgtctgatgtttcttcacatctagattcaggtgttgaatctttagcaagaaaatcacagaagggatgctgtgttcccattgcatccaatcaggtggcacatgatttctctgtgtcccattaccaatgatattcactttgattactagcatgaggtgccatctaccagatgtctctactataattttgctttttttcccttttgtaatttataagtatgtgagagagacactttgaaaccatgtaactgtccaactcttcatcaaaccatcaacttattcattaatttacttatatcatcatggtcgcgcatttcctgttttattcagtgacttaaaatctgtcactaacatgattgactttgatgtttaacttgtcccagatgtgggcagaaatgcctttgtgctgccatgtgccaatcattatctgagcacttccttgctttctggcacaagatgttccaggctcaccttcttctttcactgccctagcccagatatcagtcaatcctccaagaaaccctgaaccttctagtggagactatatatagaagccaagatttgggtgctagatgtgctcattgatattggtgtgttgttgctcacaagccttctcagtggatactgtgtgttctagggaacacatacacaaaactgcacacatatacacacacacatatatctatatgtgtaccaatttaagtctgtgtatacatataatacataaccacataattatacctatctacatatatccagacaactataattatctctacatatattgattgctatatctatctatagaaatagatattgatttctatctatatattgaaattcatgaattcataccaatatatctgatttttaatccaacatcacagaatccatcctagtcctttccctttctgtatttgtattgtctttctaagactaaggaaccaggcccccataataattatatttactcatcactgtaaccaatttcccaacccatctctcccatgttgatgtcttctcagcccgcttgggctctgattccccttgttgagcaaccctcttgtgtgaaaatccttttcacccagcttgggctctgacaccccatgcctggccactcccatgtatggacatcttccttaccccacctaggctcttgcttcccatagagccatctcctcttttatatgggctctgacaccaagctgactctctgtaaggatgccctccccattctgcttgggctgtgagtccccatgccttcccacactcactcggatgccctctttgccctgcttggtcttcaacaccctacatcaggctactccttcatgcaaagcctaccttgctgtgccctacctaactgcttgttcaagattgttcaggaaggaaagtaaagggaaacaaagataaacatttcagttgtaatcaaggaaatattaaggaagtcttcattatgcttttgtaaaaaacaaagtaatgcatgcaactaatgaaaattcaggcagttccaaagagcttactttccccagcccacccctagttcgatttgtctgcatattcaagcgtatgtaagtatagcccttttttccccctttgaacacagatgggcttatgttaactggcctgccacttttttcttttcccattaaatgtacttcggaggtcttcatatggcagcacaatgcatctactttaatatttgcatagctttgttgtttgaattataaatggatatctgtcttccgctgatagtcatttaggcttctgtttctgacattttctttttataagcaacgctgtaatgtatgcccttgaagaaatatctttgggtatgtttctcatcacattttcaacttttagaaacttatttaatctcaaaatcaagtagttcaaataaataaggatataaaaggcagactacttaaaaggcattgtattttatcttaactgcgaatttgttttgtgtcataaaatgtagggttcaaagagcaaaatcagatgattctgtccatacactagagtctatctaaaatcctttttatagcagatgaggtaacttaaagaacaaagtccaagcaatttaataacaaaaccagagctagcacccatgagtcgagcgagggcccacacagaagtgaatgccacaggagcaaacttccaacctccaggaggcaatcctcttcctaatatcatttgcagttctacctggaactgcatcacttacatgcccagaagcaattgaattccatgtgtcttttactctttgatacaagtagtgccctggaggtggagtcaggttaaacattttgcccctgttctatttgtcttcccatgctaaattaatcattctgttttcaacccttaattatcttcatcatccccatatacatcacacttaatgaaagacaagatcaataaggaagaagaagattgataaagataaaactgaaaacgagaccttaaagatgaagccacccagagaagaggataataaaataaaagaaaaagcaaaagcggttcaaagggggaaaattgccttctgagaattgagaaaaggctaccagggtacagaagatacaatagataaattgggggcttaaagaggcatacaatttccccaaataaaatatggaataagaaaaactaaggcatatcaggggaaaaagaaaaagcaaaatcactggcttattcttctcctctaacttaaatatttctttgaggtgtcaagttatttcccagtaaatctcttaaatcatagactgagtagtcatattcagattgcagtaatcattaagcggttgttcatcatatgattgtctcaactaaatatagaaggaaaaataacataggaatataaggcacatcctcacaagaaagaaatccctatcacaacaaaactatttaacaaattaacataaattaaaatggtcctcatcttatgaaaaaagatacatgacaatttttaaaaagtatttaatacacatctgaagtggatccttcctgtgtcacatcatagaaatagcaacctggagacattttaaagttaattttttacaatcctaaaatataccaactcaagtttccgatgattcttaaggtgatagcagccccaaggggttgcactattctttgtggtttccgtgtgccttgcctccatgtttataaatagtttctttgctaaaccatccttgaattatcctaattccagtgtactgtctgtttcctgctagtgggcttgctaatacagagagtaaatgtagaatgatcttccagggagattagaaaggcagtggtaggcataattaagagaaagtaatgatcttccagggagattagaaaggcagtagtaggcataattaagagaaagagacaaggtgaagccatctctgttctttaaatctttttgaacatgtttgcatcatatcatgtcactcagagtgcaaaaacataaagccatatttaaaaaatattattgcaatgacatctaactgtagctgtacttgtcaaggttgagagtagctctcttgcgctattctggtcttgcaaggtccaggagaatgggacaattccctgatcttcagtctctaggcattactgaggcagttgctccttccctagagcattatggaccttttggaaataggcatccttctttcttacttcagccaagagctcctttgctaaggctccttaggcctcagagaccatcccacagctattcgcagctctggggatacactgtgcctcaggtcaccaccacaggcagacctggcatcgtttcttaactttccagtagctagaatccatttctcatcctctctggcccagacaaccaaaatgagttttcaatagattccagatggactggaaggacatgcagtattctcttccagtccatcttccggaatgccccaagaaatccaattgtaactgtggatttgatcatgtcactcttctgctacttccttggctttctattgattatgagataaaacacaagtatgaaatagaagagtcttcacaatcttgtccccagcctatctttctgactttacctttggtcactcgctgtccttcctctccagtaatctccttatattctaacttcatggagctattgttcatccctgaacactcaagtaatagaagaaactaatgttaatgagcatctatgctgtatcccctactgtactaagcttggcattgatctcatttaatccatccagccgataaggaggctgatgctcaagcaccttaagaggcttaagcaagggttagaaccactaagtggtggagaggaagctgacctgggccctgtcttcctgacatgatctgatctccaagcctcagagttattggtggtgaagagctcccaacctgaatgttcttttccaccttcaccacctggttagaaccttctgcttccttaaagaaaaacctggattttcatttcctctgaactcttccatggctacagtatacagggttggtcccttcttgcccctggaccccatagcactttcaacacctttctgtcactgcttttatcacatggtctcctcattacctgcatttgtgcccatccatcattactaattgcagtcggtttttttgagaaccaggaccaaagggatattattcacctctggtccttagttgttacacagagtctggtaaatatatgacgctctaccaatatgagatacagtaaaaaggaaggaaggaataaaaataaatcttagaactatagattgtcccaccactaccttttgatatacctgaaatgtaaagatttatgctttgcctggcaggaaagtttctaaccatatacaattctatctaagaatgccaaataatgaggtatgccatatgtatataaaactgagaataaaagatttgctaaaatgtcaatgaaaaataaacatttaatggcaacagtatcttaaaaagtgacccaaatgtgcatcatgtcttatggttctccacgagatctgaactcaattttccaaaattaactcagaacatagaattaaagttaaaaaggacttagcagcaatgatgaattacttttatataagtaaaaggataagagaaaataaatacggtagacttatgaaaacaaaatactaaaagaaagattaaccatttaagatcaaaggtgactcgaaaactctaaagctctaacaggaattctcaaagtggattctagtgtctttagtgtataatatctgaatagtgactgaaagtaataaaatcagcaaaaaggaacacaattatggtctggaattgttattttcagtgttctaatttaggattaaaaaggaaaaatgaaaataaactattttaacagctatgtattagaaatatgaagtttaggaagatctcacttgagagatgtgaaatataattttctttcttctgaggaatagagtaaaacatatttactctcctcaatacaacaagaacaacagttttaataaaattcctcagttttctctgtgtacatttgtatgaaacactatgacagtgaaaagctatttaatatcaaatgaagacattaagtggtaacagaaggatattatatttgaaattcagtactgtttttccactgattaagcatgaaatagaaatcaacaattctcagaaaagactgaattgtctatttcagaagtttgtggtcaatggtctaaaagttagaacaagggaatgctgttgatcacaaaataagttctatttacaaaagaacttcaaagtaatcatttgtaaagttattctgcacttaatcagtaaagagtacaggaggattattttaacttgcatatatttaagtagttcatttcaagacttttttttcttaaaagtaaccaagtataaaaaaggcatacttttactgagacacgaagtccccaagctaattaccataaaatgaatgagcttggaatatataaaagaagatgtgaaagtgttttatccaaagacagttcaagaacctttgtgtaaagaacagtttctgactctaaggcattggcatatgtgcaaagattttaaaataaatgtgttcaagacagggagtaatcactggttgctgattttgatcgctaagactaaactggagactttgtttttcgggataatgcaaacaaaactgtcatcatgtagttaatgctctattttgggaagacagtctattgcaaattactttattaggagtttacttgacatccatctagaacagactgtggttcaaaatatcttatttgcaattcttttaaatagatgttgtaacatgtgttttccactttcacaataaaggatctaaaagtaagataattattttaaatgcaagtcacaagtcacatattcctttcagtatattcactaacatcagtcttgaacttaacaccaaacttctccaaccatcctctttagtagcctgaaaataagtgtttcaaaacatggaaagtgaaataagtttccatttcattgtatctagtttcaattatttatgtttctagttcattatttcattggtttgttcacgcaggtcatatttctggagtagttagtatccaagaaacctgctaggacagagagcagagtagccaacagggcaaattcaatctctgctctcacagggcttacagtctaacagggaagacaagtaggaaacaatacttgcacggaaatcttttcttttctttttttttttctttctttctttcttttttttttttgagatggaagtctcgctctgttgtcaggctggagtgcagtggcgcgatcttggctcactgcaacctccgcctcctgggttcaagtgatttttctgcctcagcctctcaagtagctgggattacaggcgcacacaaccctacctagctaatttttgtatttttagtaaagatggggtttcaccatgttgcccaggctggtctcaaactcctgggctcaagtgatctgcctgcctcagcctcccaaagtgctgggattacaggcgtgagccacagtgcacaggcagaaatatatttcctatatacacgatgataaaatagaaagctctcaagctttagaaacatgcaaacctaaaatcagatcctgcctagatgtgaggtagtgatcacattttggtctcctcatttcagcaaaatagggactgtgatacctaccatacttaccattacctgggatgatgtctggaggaggcctgacaattaataggtattcaaataattccttttttctcccttatttgcattccctatcccttattttccattaatataaaacaagataacaaaaacttggcagtgaaaagctcttttcctctattaaatttaagaaaatgtaataaaaattcagttgaaagctaaagctaaaataattttcttagttaatgaaagggttatctatactgagaataagtatatattgaattttgttatcaagttcctaatctattctggatgttcatccaattttctcacaatagaaagcattttttttaaaagaataatattttcattatcttagggacaatgagattttatattcaaaacaacaaaacccacagaaagctaagaataaagcaaatatattctgcactttttcctcttaagtataagaaaatcaagtttatgaaattaaaattatttaggtctatgcaatcaatttaaatttgaacaaagctaatacagttaaggaaattacaagtagtttacaacaacttttttttttttttgcttactagggttgttgggtaaaacaaaatgttaatcttcattagaaggttcatgtatattcaaaattttccagagttttctttcaactatatttttaagacgttaagtagaagacttaatcttgtgggtaacattatggaccatgacaaccctattccttatatttcttcaggtactgctggtgctcatttaaaccctataggcttaactctgagcactttaatttgttatatttcaatttaatctgactttccttggaagaaggtttaggatttttgcttgtgatctaaaattctgataagaaagaggattctgctaccttttcttcttgagatgtaaagaaagagaacagatagtgtaacttcagaataataggatcttggagcaagaaggagacttaaaaaaaagtaacttagaccaattcccttattatattaatgagaaaagttgggagacttaaggttctatttcaagtcaatatcagagtcaggaccggggctcagtctgtggttcagatgtgggggtggctcttaaggtgtgggaaaagtctaggggtagctgggtgagttggggtctgcacctgtgcatacaatcttgtgtttctctatttcttctggaaattgcatgcaaacaaaacacttgagaatatctgctttactgaggggtgtgagggagaactttattatttatttcaaaattttgaatccatgttttagggttcatgcatctgttttcagcattccatgcaaacttttaaaatatcttattctatatccttttaactgttttaaagacaacaaagcaataaaccacacaaacaactaaacgtgttatataccaaatgttaacacattggagacttccaattcatagttctttgctgctaaattaacttacttttctgcaggtctttaaataaagcaggagtcccaaagcaagcgacaacagggaccaaggaggtaagacagctgaagacagtgaggacttctatgaactggagagcacagccccatctaatccagggagctgattgttgcctgaggaaattcagcaccagtgttgccaggtcttaattaattctttcaagaaaagcataaaactctgtatcttgataaactcatgaaaacagaaatttaaaaaactacttagggattcagtcagtgactggctcattatcacttgctctaattaactgcatttactaaccacagggtgaaaatagaaagtcgcatgaaggtggaatagcacagctttagaagccagaaagtgcgggtcagaatgttctctctagaccttcagagtttcaagaccatatgcaagtacttaactcagaaagactcagtcttcgtctgtgaaatagagaacaacagtaccaccttatagaattgggtgcaattcaaatgagataatacatgtacacactgtgggatagtgccatgcatctaaaaaactttttatcatcatcatcatcatcatcatttcttcattcattttgaagttgtttctttatggctatactacaaatagagtcaatgtaccataatcccatagagcaaacagacaaacacattttatgttcataaacattgtcttttaatacaagcatattgaatgattttttttttttttttgagaaggagtcttgctcagttgcccaggctggagtgcagtggccccatctcagctcactgcaaactccgcctcctgggttcaggccattctcctgcctcagcctccagagtagctgggactacaggtgctcgccaccacgcccggctaattttttttgtatttttagtagagacggggtttcaccatgccagccaggatggtctgtatctcctgacctcgtgatccgcccgcctcggcctcccaaagtgctgggattacaggcgtgagccaccgcgcctggcccatattgaatgattttaaaaaacaatttaattctttaaatgtacatagaaatttaaaattattgttttcacaattcctatatgcacataatatacaaaaacaatatagctataggaaaagaaatagaatgtggtttcccctgacatagaagattgaatatcatttccagttttagccatttatgtagtagttagcataacctgcctgaattcttcttgaaactgtgattgttgccggccctagtagaatctgcaaaggctatcattttaaaattaacctttctggacaggcatctgcatgtgatttaaaatttttcttcaacatcaaaatgtaataatttgaaaagcttttcttctccccgataaacagcagataatcatctatttcaacaaagttgttcaataaaattttgtgaatattagaagatccatagcctatcatggttttttgtttcaaccgtcatccacatagctacgccaaatccactgagctctacgggataataagaaaaggccccaccatatctcacggagtttagtgtcaatacaagaaaatgagtttaaaagttccaaagataacttctttttagcgcttctgtacatgtaggtttgtgcagaagacagttatagtagttagtgatttaattttaccaatttaaaattactatctgaaaaatggattcaaaaggtagggatttacacagggtttttgctgtttttatttggtttcaacacatttataacatttttaggtgagctaaaaacttagcgcacctaaaataaataaaatttatttcccaaataaatttcaggtgtgctaaagatttagcacacctaggataaataaaatttagttcccaaataaatataaatatgtaacacgaatcatcataataattacatagacataaactctttcctttgcaaggctcggaggtcaaggaaacaagactttagagacttaagtgacacccacaacattcagaagctcaagggcactgcagtaagatggaaagggcaagtcaggggctgttctgcatctgtaaacaggaagagcaatagtctccttatttcccctaaggaagttctgaagtacagcatgtcatctttcccctaaaaaggctcactaaacttagatttctaaactaaacgtcacagttcaaaaattgctctggagctttcagacttcatttttgtccaacctcatgcttattgtataaaaggaccaatttctgaaaagccagacgatagggagcacgggtgagaagaaacctgcattatattgtcaaagggccgactctgagattgaaattgattccatgaagtgcacattcacataaatatacaagatccacctcggtttagttttatttccccacacatcaaaatatcaaaactcattttccaaaagatcaagatgctccaaatttcaaaaaaagagaaaagcagccgaggatgaataaccttttctataccacaaaattaccccttgcaaaggacaactagattccttgtccacacaagagaaacggttgttgagaatgtcagaaagaggagacctttcttttcagcgctaggtggcagaggagagtcgcctatgcgtccaggctgtcctggacagctgtggttgacgctaacgcctggctgctctcactttcaccttctctctggtgtcaaagagaagccttgaggccgtcccgacggcctcttccttacaggggaaactgctgtgagctgaacacataccgctctttcaaacctttaagtgcagcttagttaactggtggaattaagcccacattgaaggggcctaaatatacaaccctgttcttcaggttaggagatcacatgtcaaaatataaccccaaattaatataagaaacacgctgggggtgccaagtgttgaactacttacagatgctgagtcctgcaggaagctctgagatggcgcctgtctttctggcgcgcccgcaggaagaggtttcagctgaaacagcccgcgagcttcattcgagctccacgtgggggcgagactccgaggagatgtctggtcggatgctattgccatgatcaactctccttagtgtttgcaaacctcaaagaagaggttttgaagaagtctagcttcagtatccacccatgcccattaagcctcattttctgttacaaaaatgaggttaataacagcatctatttaaagggttgtgaggagtgaatgagattgctgacccatgaaaagtgctctgtatggtgctttctcaaaaaaatactcaaatgttagctatcattattacccctgccgaatgagacagggaatgggaaggttctgtaaaataaagagcagcctcatgcccactctcctcgcaccctctatgcttcctctcagccggtagactcggtgtttctgcaagcacatcctggaatttctcccgtttcttcagtatgtaaagcatagcgtccacagctttatgctatgcaatcagataaaggtgggtctgaaaactgcctcttagccatttaccagctatgcaattttaggcaaattgccacctttctgagcctctgtttctccatctgaaaaactaggaaagtaataagacttttctccacaggtaatttatgaaaatgagatggtgtactgtcaggtgcagaggaagaattcaccaaatgttagctgcaattagtagtattcgtatcactattaactttgcctggcgtaacctccccatctaaagctgctttctttaaaggctcactttaaaaatgtctatctgtctatatgtccgttctctcatgcaacacatattcttgtgtctccttcatactctgggggattaagaaatgaatttgacatagttcctgaaatcaaggagctgagtgtctggcagcagaaataagtcagtcaggtgtataaagtttttaatgcagtgtagagtgctaagtggcctaacaggcatttattttaaagatggtgttaatttggccaggcgcggtggctcacgcctataatcccagcactttgggaggctgaggtgggcgggtcacctgaggtcaggagtttcagagaccagcctggccaacatggtgaaacccgtctctactaaaaatacaaaaattagctgggtgtggtggtgcatgcctgtaatcccagctactcaggaagctgagacgggagaatcgcttgaacccaggtggtggaggttgcagtgagccaagatcacgccactacactctcgcctgggcgacagagcaagactccatctctaaaaaaaaaaaaaaaaaaggtgttaatttaacatgaggagaatctaggaagggagacaatgtgtaccatatactattacagttagcagcatgaagttttgggttacggagatctggggttaaatctcagctttacctcttgctttttaaatatctttggataattcatttgtttatttttttgagatggagtctcgctctgttgcccaggctggagtgcagtggcgcaatctcggctcactgcaagctccgcctcccgggttcacgccattctcctgcctcagcctcccgagtagctgggactacaggcgcccaccagcatgcctggctaattttttgtatttttagtagagacggggtttcaccgtgttggccaggctggtctctgaaactcctgacctcaggtgaccggcccacctcagcttcccaaagtgctgggattataggcttgagccaccgtgcctggcgcgttagccaggatggtcttgatctcttgacctcgtgatctgtccgcctcggcctcccaaagtgctgggattacaggcttgagccaccgcacccggcctggataatttataatattctctctgagcctcagtttctacatctgtaaaacagagataattgtagagtgtacatgatggagggtgaagtgatcgttacatacagaaatccacttaaaatgtgacagaagtttcaataaaggttagctcttattcatagtaataatgttaatatagctaatcttgtcaccaagtcttggtgctggtggcattgaatggttcttgagttatgagtaggatttcaatacagggctgggggaaggagatgaggcaggaaggacagctcagaagtgagaaagaaggcaaagtcagaatgaacagagggtggcttactctggctaggctcagtctggcctcatcacacactaaaatgtgtagttagaacaatcacttgtcttgctttacctgggactgaagggttttctggggaagcagaacttccggtcagcaaaaactggggaagtcttgggaaaaggaggataagatgatcaccctacatgcattaggcctttcttgtgttgctataaagaaatacccgagactggataatttattttaaaaaaagaagaagtagtttaattggcccacagttctgcaagctgtaaaagcatagcaccaaaattgcttagcttctggggagacctcagggcactagtattcatggcggaaggcaaagtgggggcaggcacattacacggtgagaaaaggagagagtggggtgggggaggtgccacacacttttaaatgacctgatctcctgagaactcactatcactaccatgaggacagcactaagccattcatgagggatctgcccccatgacccaatcacttcccaccaggccccacctccaacactggggattacattttaacataaaatttgggcggggacaaatatacaaactatatcactatgcttcaagaattgtggctcaacagacaagggtcttgaaggccatgtgagggggttgaggctgtatttgtaggcaataggaagctcttgaaagtttttgaggtgaggagtgactattcagaagtgtgtttcaggcaatcagcctacaaaacaaaggttttgtctctcatccttgcccaataagtctcttctgcattgttccttccacagtccttggtttatatctgccctctctgtttatcacactgtatctgtgttaaaaatatatgtgagtgtcctcatcatcttacaatataatctcctcaatgtcaagattgggtcttcaccatcttatctccattatgtcttatataagctcaatatgtattgaattaagttgaaagcttgtgattctatacaatacaatattaattgacatttacaattcatctcggttcaaaattgaacatcaggtgtcagtgtgtctagtaattattcttctgatgacatggaaagtcaatctttaaaatattgattgggaaatctacacacaaaataatcctctgtaaatgtaagaaagtgttcttctcttttccatgaacatttctaattgaaaaaactgttcttacccactcaattgaccagtaaatgctttgtagtatgatgttctcttccctttctgggcctgagatacaggttcccatggaacctcgactgtacctgtatctcaggtaaaggagagcaattggtagagtttccatgcagggttccagttggcctaaggtcatttttgaatgcttacgggaaaagtttgttttaggcactgatatggtttggatcagtatgccaaccaaatctcatgttgaattataatccccaatgttggagatggggcctggagggaggtgattcgatcatggatgcgtttttcatgaatggtttagcaccctccacgtggtgctgttctcataatagtgactgagttctcgtgagatctggctgttaaaaagtgtgttgcaccgcccattggctctccctcttgatcctgctgcagccatgtgacttgcctgcttctcgtcaccttccaccatgattgtaagcttcctgaggctgagcagatgccagcaccatgcttcctatccagcctgcagaaccatgagccaattaaacctcttttcattatacgttacccagtctcaggtatttctttatagcaacgtgtgaatgaacttatacaggcactgtcaagtcaatgaatcaagtaaaaagcatttacacacagaccctaacttataatggtttggcttacaattttttgactttacaacggtgtaaaagtcagcaacattatgtataaactatactttgtgtacccacacaaccattctgactttttacatcattgctgtagtcaataaattatatgagatattcaatattttattataaaattggctttgtcttagatgattttgcccaactgtaggctactgtaagggttctgagcatgtttaaggtaagctatgctatgctatgatgttcagtaggttaggtgtatttaatgcatttttgatttacaatattttttttgatgggtttgtcaggacgtaaccccatcataagtcaaggagcatgtatatttatttctatatgtacaggattgtggaagaagccaggatatattaatctgtgagataacatagcatggtgggttttttggtttgcttttgttgttttgcttgtttgtttgttttatttgagatagggtctagctttgttgctcaggatggagtgcagtggtgcaattatggattgcttcagcctcagactcctgggctcaagtaattctcctgcctcagcctcccaaatagctggaactataagtgtgtgccaccacacctggctaattttaaaaaaaattatacagacagggtctttctatgttgcccaggctggccttgaactcctggcctcaagcaatcctcctgtcttggtctcccaaaatgccgggattacaggtgtgagctaccacactgggcctagcatggtggttttaaagcaaggattgtaaggccaaaatgactagagttcaaattccagctctggatttcactttcttatctttgataagatattaacctctcttagcctcagtttctttacgtgcaaaatggaggaaaaacagtaccttcctcataggattgttataagaataaaatgagataatgtatgtaaactcctaacactgtgaacacattttatgcaagaagtatgttcctaaagcccttagatactctaagactgacccaggcaaaggatgaaatatgtttcatttactggctaaagacagacttccttgtagacagttcactgattcaatcactcattcattcacatagtttataaacacttagctaaccaagctttgaaattacatgattcttgacaaattttggattcctggctgggtttgcttgggttcctgggaagcagatactacgtagagatgagcattcaagaggcttaagggctgggcacgtggctcactcctgtaatcttcgcactttgggaggaagaggctggtggatcacttgaggtcaggaatttgagacgagcctggccaacatggtgaaaccctgtctctactaaaaatacaaaaaattagctgggtgtggtggcgtgcacctgtaatcccagctacttgggaggatgaagcaggagaatcacctgaacccgggaggcagaggttgcagtgagcagagattgccccactgcactccagcctgggtgactgagtgagattccctctttaaaaaaaaaaaaaaaaaaaaagcttattaaggagtggtgttgggatatttacaggtagggaaaaggatgcagttaaaacaaaggctccagtcaaccctgaaggatgctctgaagctgagatatctcttttaggatgtccaatgttaaggcaaaggcactgggttttcatacccattttgaccagttcttccagttcttgaagggaaggaggtatggtctgcagcagggcagctctcttcagctgatgcaaaatctggagagacactgacctgagatcagtcagcccattttactcccagcaagtgggtaaataaggcctgaaggagggcatcttagcagaatgataccctgtctactgcaagccaggttgttgtgacttcagatgtacataaagtgaaactttatattttattgttacataatttcaaaatgatagactttgccacctccctgggtatgtgccctattactattgtcatgctgccctagacaatgaatttcccatttatttaatggtgcctccttcttagtaatttggtaaggattacaagttacgtaatgtatagaaggtgctttacgaagatcctggcatgcagcaaacgtctggcacgtgttagctgtttttattaagagaaggtctatgaatacagaaggactcagtaataaatgaaggaaaggaaactatgttaggatttaaaaatttgcagactgatttaaagcactggcaaagtttacattatggtatttgactagtgggtgtctcggtctagttttatgtcaacattaattgaaggtttgggttttggcacctggtgggaagcctaggcgagactgtgaacattcttctctccctcttattacaagggaatttaagaatcttagaattacactctgtccatttggggaataaaaacgtaaacaatcatagcaaaaaaaggacagagaccaaccaagatgtaataaaggattcaaatatgagacacaggaaatttatcccccaactaggtcctcatccctacacatgtaaaaatattcattatttcactcaaattcttatgagttcttgtagacagatactatatttctctaaatgatttttttttttgagacatagtcttactctgtcacccaggctggagttcagtggtgcgatctcggctcactgcaacctccgcctcctgggttcaagcgattctcctgcttcagcctcctgagtagctgggattacaggcacacaccaccatgcctggctaatttttgtattattagtagagacgaggtttcatcatgttggctaggctggtctcaaactcctgacctcaagtgatccgcctgcctcggccttccaaattgctgggattacaggcatgaaccactgcgcccggcctctctaactgctttttaatgtgctaaacatagtatgagcacaatgaataaagtgataatattccttttggctgtcttaggtgaaaggtgattttaacacacacacacagacacacacacacacacacacacacacacacatttatatacctatttgtaaaggtagattcaaaacaaaggcttccttaacagtgtcctgctcctaccccttcctcatccccaataggattcagatgtttattttcagatgaggaactatgtcctactctgattttgtttcgtttttattaatacctctacaagtacttagcacagtgtctggaatgcagtgagcgctcaataaatatgtgctgaataaatgactgaataaagttgagagctggaaaggaggttagagattatactgccctcattctagaacagtattcagagagattgaagtatatgtgggaagttgcagagctctgagtcagagtaaggatccaagtctccgaactctcccgcaaggacccttcccaccaaaggagccctgccaactgctgcactttaaggacccaggcaaatgtgctcagagcattgcatggcagtcattccttcccaaaaagtttgttctcctaaagacatttgtttctccaagcctggaagtaaaacagagcacttagaacccataaaataatgttaatgtggcctactcttctccacatttttttcctttcatgtctttgtgaaacttccttttatttgtaggacgtatagcatttcttcagtaatcattaatcattccttatggttccaaggttactctaattatctattaattccacaaatatgaagtaggtgtacatcatgcactagacagagaaatgaggacaagagcaagtctgagggctggaaatctctaaattccattttattttaaaaaatattattcattatttgaaagacaagatttttttaaagcatctatgatctcacgattgtcacatgataatggcaggataatagcatgataataggattctggggaaatttctttctagtcttttctctcaggcatattttttcatagttattacaaaaatgcaccaacatctgcaaattctttctctcttaatattatatgataagcatttctttcttttttttttcttgagatggaatctcattcactctattgtgcaggctggtgtgcagtggtgtgatcttggctcactgcaacttccacttcctgggttcaagtgattctcctgcctcagcctcctgagtagctgggattacaggcgtgagccaccacacccagctaatttttttatttttagtagagatggggttttatcatgttggccaggctggtcttgagctcctgacctcaagtgctgcttcccaaagtgctgggattataggcatgagccaccatgcctggcctatatgatgaacatttctatgtttcaacatagctttcataactataatgtttgttgattgtacaatattctattgaatgcatacaccacaactgacaaccattttcctaaaggtgaaccagaagtcaaagaaatggactttttgtggctctttaagtgcatattgccaaattcctgggtcaagggatagaattctgaatttaattaaatcaaataaggaagtagcaatggggatgttactgtgaccgctactgccagcaatagctgagcctagtgtgcaaacataaagagttgttctgagctagggcccacctttttggctcaatgaagactcattagaattctgctggatcaagaagttatatcttagagatctgcattagaaatgctagctaaactgtattgttgccacttcttacacctgactgatctgtgacagttttctaataaacaagagaaagaaaactttttggggaaacacattttcacgtcatttttttttttctaacgaggtcaaacaggttctgaagccaaggcttaaagagatagagtattacagcattgaacatttctgcaacattaaattttattgtcagaaaccactatggcttagaaagaggccactaatcaaattagtgtccttaggggcctgagtttaccactgagtacatagcgacgtgggactgagggtttctttgctgtactcatgtggtcatgctgagatggaaccctcaggaacacatctggataagttaagcaaacacattttgatgcttcattcagtagaaagggacccccatctgttcttcaccacacaacctaattatcgggtaaatagacactttctttcctgcatgtttattcctcaaagcaatgtctccaagggtggctgaaaatgaagaattaaaaacaccacctaggacttgagcatgcttctgttttcatacgaattaactttagaagatccttgagagttaagtactatttttatccccattttacagataaaacaatgaaggctcagaagcatcaggtgatttcagtcaccaggtcagcaaggggttgtatcagaactaaaattctcattttggatctcaaatcccatatgcttattaacctcagtgccataaagatgaatcacagaaatatgtaaggtgactgttaaaaatcttagtgccatttcaaagattctctagacatgagagttacaatagatggaagacgcaaagaaatgacaaaaactatgtcagaactgtcacagactccaaggcaccagaaaaaaattggaggaacagaataaacaagttcccaaacacaggtgcagttcccacttcagccggggaagacactgtgcctagaaaagctcagaatcatgccctaaaatacccatatcttttcgattcacactggaaacaaacagccttaccccatgcccaatttctaatcattcagaagactgagattatacacttgacctcacaatcaagatttcataaatgcatacattttgtgctgtctttaaaccatcagtgtgacctttggaatattcttaagattttaagagacttccatagattatctgagccaggcctcagccttctgacaaatctgaatcattatccacatgagggaactgaggcctggagaggttgtgacctgctcagggtcctacatttgggaaagttagaagaggaagggaaaggagcctcctgcagggaaggggctttttccactatgactgagggagaaccaacatttccttttgtcaatagacctttcagccaataaaatagaaattccattctgtttgaaaggttgcaactatcacctcttcaacacttctcagagaaagagaaaagaattatctggctgatgagatggcaaaaactctgatctgtatttctctattagaagctattgataggtttaacattgctttgctcccatggctctgttctctccacatacctgaacttctgtttgtgctgggcggacacagttctttctacacccagatttgggggaaagcatttagaattcccctttggccatttgtccatatcattctttccaatcaggcttggccagatataaagctattgtattgatccctgtttactttctacgcctaatattcagttggtttaggatccagacagggggcgagtaactgaattaatttgcttccttagaaacctccacaatttccaagacttcttttaaagtttcgccgaacttaattcttacatacatgtattagaagctcccttaacaaacctcagacttagcaacttgccagatgaatgatcaccccctattgcaggttttcctattaatagcactattgacatttagagccagataattctttgttgtgggggctgtcctgtgtaatgtaggttgtttagcagcatacctggcctctacctataatataccagcagcatttgcctagttgtgacaagcaaacttgtttgcagattttgccaaatgtccctcggagggcaaaattgcccctagtggagaaccattgctctcatccatcaggaacacagaatgcctgataaccacagcctgctgaaccctccaagatgcccatgctctcctgatcccattagttgagctatgggcttatcaagtgtcaagttgtacatcaaagctattaatgtcgcttgcacttgtaattatgtagttcacataaatatcatgccatccaatgaaatgtgacacaaagaaagacagtatttgtttgcttttttttttgaagtcagatgattggaagagactctatatggcagagacaaattatttcttcagcatatcttttttttcttctggatatacaatgaaacaattcctagcctcccctgcagttaggggaaatctatttgattgaattctgggcaatggaaagtgggcaaaaatgaataccattttgaggtttagcacttaaaattctccttgttctctcttgctgcttctgtaaaggatccagaagaggtctctgatggcctaaggcagggattgacagactttctttaaagggtcggatagtagacattttcagcttcccatcttattgttgaaaaaacagcctttggcttatgggcagtagattgccaacccctgctggcatgataggtgtgatggtgcaacagcatttcccacaaagatgcttaaaaaaaaaccctgtcacattaagtataggtaaaacaaatatataatattatgggagactaaaaatctagactgattctatacacagatcatttcaaaactctttaaattctcattctactttaaagatattaaaagtagaaagcatagactgtgcaatcacagacactatataaataaggaaaatagtgcaggattctggtcagcagattcagtccaaggtgacgtcttggtcttacaccaaaatactggtgagaatgatcgtttatgttttgaattcaaattaaaagtccaagctctgtatcttttttttaataatcattcttgattttaacaggtttttttccttctctttttttttttgctcttcttaaattttttcataggtttagggcatacgagtctaattttcctacacagatgtattgagtagtggtgaagtctgggctttcagtgtacccactacctgaataatgaatattgcactaaataggaaaaatttcaaccctcgtcccccatcctgccctcacaccctttggagtctccaatgtccattgcttcattgtgttttaacagactttttactaaagtaagagggctctatttcgactctcttttgtgtgaaaatagactgaaatggtacggcagaagggccttaaagaaatgggagagtcccacaatactgattcctctgtcctgggtcttggctgggacatcacctttcccagatatttataatacaattgtggcaacattctagatgcagaaatgttagactccctaaattttgccatataaagatgtacaaaaacagcagttagtacagtttatttaatataaatggacatgggctaggcataagaacaaggtaaggaaaattaaaaaaaaaaaaaaaaaaaagaaacagagaacttctctcctgtagttcctatcagctctccctcgtaacaaaatgtttgacaattgtttcaggcctcttgggctgccatgacaaaatactgtatactgagtggcttaaacaacagaaatgtattttctcacaatcccagaggctagagatccaagattaatggattttaatgaatgttaatgcattcattaacaaagatctaaggtgtcagcactgtcgggttctgttgagagctctctccatggcttgtagacagttcctttcttgctgtgtcctcctatggcaaggaaagagagaaaggaagagaaggagggagaaaaagagaaaaggagggagggagagctgtctagtatctcttattgggggtgggggttattttacagtattttattttattaattttattgtttacattgacaggtaaaattgtacgtatttactgtgtacaacatgatgttttgaagtatacatacattgtgaaagaactaaatgtggccaattaacatatgccgtacctcgaagttatcatttttgtggtgagaacactttatattcactctcttagcatttttcaagaatgcagtatattattagccatagtcaacatgttgtgtaatagatttcttgaacttattcctcctgcgtaactgaaactttgtatcctttgagcaacatcttcttaccctgccccacccaaataccccagtccctgatgactaccagtctgctatgtctatgagatcaacatttttagattcacatttgagtgagaacatgtgatatttgtctttctgtgtctggcttatttcactaaatgttttccaggttcatccatgttgttgaaaatgacaggatttcctccttttctatggctgaatagtttccattgcgtatatataccacatttttctttctttttttttcagattagtccactgaagcagtgagagtatactgcattttttttttttaatccactcatctgttgacggacacataggttgattccgtatcttggcaattgtgaatagcgttgcaataaacatggaagtgcagatatctgtttgacgtactgatttcaattccttaggatatatacacagtagtgagactgatgggtcatatggtagttctatttttaattttttgaggaactgccatactgttttccataatggttgtacaaatttacattcctactgacagtgtgcaagtttcccttttctccatatcctcgccaacactatattttgtctttttgctaatagatatcctaaaaggtatgaagctagtccagtgaaaaaatgtggaatttagctataaagttatatcccagatggcaagttttgtttcctagtctgagcctcaagccttgtggaacaactgactccagaatgtcagctatgatgcctggcaaaaggatatttgtgggttgttaacttgtgaatcaaaaggcaaaccctggcccagcagtatgttatacctcattttggttttaatttgccttgatatctcttcttatgagggtaccaatccgacaataagggcctcacctttatgacctcatgcaaacctaactatctcccaaaggcccatccccaaatattacatgggggtttagggtttcaacatatgaatttgggagagatacaattcagtacacagtagcaatcaacaaggaagtcaccaagggtgcaatctggtacaacgaagtgttaggcctcatatgcacccaagtgctaattcagcactttttctctcagcataatgtatagcgagtgagccaggcagcctagggcctggtgctgataaatcaaagtcatttcagactaaatcatcataaaaaagcatacctttgccgggcatggtggctcatgcctgtaatcccagcactttggaaggctgaggcgggtagatcacaaggtcaggagttcgagaccagcctgaccaacatggtgaaaccttgtctctactaaaaatacaaaaattagccgggtgtggtggtgcacacctatagtcccagctactcagaaggctgaggctgaggctgaggctgaggcaggagaattacttgaacccaggaggcggaggttgtggtgagccgagattgtgccactccaccctctccatccagtctgaatgacagagtgagactccgtctccaaaaagaaaaaaaagcctacctttattttcaccttcatccatatgcctttttttttttccgttaaggagagaaaccagttgacactgtgtggcaaaatctggaatcatctatcatcactattggaaaaatacccaggagagcagcagcatcaacttctattcattaacaaagatctcaatacagttgagcatccttagtctgaaatccttcaaaataccaaattttttgagtgccaacatgatgccacaagtagaaagttccatatctgttgaggtgtggggagctagggaagggatagcattaggagaaatacctaacgtagatgacgggttgatgggtgcagcaaaccaccatggcatgtgtatatctatgtaacaaacctgcacgttctgcacatgtatcccaaaacttaaagtataattaaaaaaaagtaaaaaaaaaaaaaattccacatctgaagtcatgttccaagttgcagtcaaacacacagttgtacctttgtttcacgaacaaaattattaaaagtattatatgaaattatcttcagcttatgtatataaggtatatgtgaaacataaatgaattctgtgtttagacttgggtcacatccccaagatatctcattatatatgttcaagttttctaaaatccaaaacatttcaaagtcagatacatgggtcccaagcatttgtgataaggaatactcaacttgtactgctttccatcatatccaaacactcactctggccaggtggggtgactcacacctgtaatcccagcactttgggaggccgagggtccagcattgcttgaacccagtagttcgaggccagcctgggcaacatagtgagaccctgtgtctacaaatgatttaaaaattatctgggcatggtggcacatgtctctaatcccagctacttgggaggctggggtgggaggatcagttgagcctagaaggttgaggctgcagtgaactgtgctctcaccattgcactccagcgtgggcaacagagtaagaccctgtctcaaaacaaacaaaaaaccaaacattcatagttctgccatattttctttaaggaaaaaacaaaataatttttattgtcatctcattgcaacagttcaagcttagtagaacctcctttctactacttttgtttctttactttttcttttgaaaatgtttaaacctgcaagagtacagtgaattcccacaaagtctttaatttaccaaaaggttgacattttaccacgtttgctatattattttctgcatatgtacttttatacttattattagtgccataccacttgacaataagtagtagaaatcatggcccttcactttagcttgtattccttttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagtcaggatggtctcgatctcctgacctcatgatccacccgcctcggcctcccaaagtgctgggattacaggcgtgagccaccgcacccggcctttagcttgtattcttttagaacaaaggcatttacctaataaacagggcctagagggtgaaaggaagaaatggctggtattcaccaaggacagatacaaaagggaccaattttttgacgaagaatttgcacagcaattaaatttcccctgtgactgcaggaaccttgtaagtaaaagaatttcaaactgagcttaggcatgctcctttgacctgttttagcctgagcaattaataaagtgtttggattgtatttgcactacaagcctcaactccctgaagagtaagtaggctaacacacaggtggaaaaattagcaatttattgattcggtacattccaaacatagttgaagctttcttaagctgtttctaagaccccaagctgtgtgcattcttgtgatcatattggctccctctcagccatcgggattaacatactgctgggccagggtttgccttctgattcacaaattaacaacccacaaatatccttttgccaggtagtcagttccggagtcagttcttctgcaaggcttgaggctcagactaggaaacaaaacttaccctctgggaaataacattaaacctaaattctaacacaatttgatgctgaaagatcaaagattcctcagtgtagtttactaatagttccccaccgttaagtataaaaaattccttccacatgcctttcgcctctgcattcaactgtgtttgacaaagcctgtctcacaaactcaattagaaccactgagcttaaacacacccctttccttggtcacttacagtagatcttttcctgactgctcctatcgtggcagggactgctcttagaaaaatgtgctcttgtaaaaaagatctcacaatagctctcacatgaagcttatcgtcaatggtcagtgtccgattatgtcatgccgtgttgtttttccaatgggacagactgctgctttcatcaagttggaggatatatttatggtactgttttgaagggcagtgttttaagtttgaattacaagatatttttgaaaatatagtcaactctttcatttggagctcaaaatgaatatactaaatctgcacttctgaatagaagtccatatgcctggacataaaatgtgcagtgatagagcacagtgggacttcatgagtattggtgtatatagtctcaactatagacatttcgaaggcataattttcatttcaatagattaaggcatgtgtgtgagaaaagcgtgaaaattataagagcccagagttcttaactattgacatttggggccagataattctttgctgaggtatagccatcctagcctctatccactaggtgccagtatcaacattcacaccccaaaaggagacaaccaaaaatgtctctagagattcccaaatattccctgagggacaaaaatcacccttggggagaatccctgcaataaattgttttggtttattttcccatgtggccaaagtaaaccaatcttagaaagtgctggtttgtcttagtcatatgtgaatatgctacggagtgtctacttacctgcacggtcacaaggttttctttatctctgcatcactaagagtgtctagcacagtcctcttataatatgtctgtgattggtgctgattcccagatgtttctagcttttctccttccgggaatggtagaataggacttcctattatacttccactttagatggtcacatgacttgttatggccaatgaaatgggactggaagtgatgcgtgtttctccaggtggaaacattaagatccaatgcacaatttaccacgtttcctttttttctggcatggtgaccaagcacatttgccaagatggctgctctctcagtctggcctctcagttactgcaaagagtagagccccctgctgatctgacttggatataagcatgagtgaaaaacaaaattttgttgatataagctgctgaaagtgtggggttgtttgttacaagtaacagtatgtgttagttacaactaacagtatgataggctaagatatgttttcagtgtcacagacatttgaattcagagcgcctatgagtggtttggttccttttcttccatactttagaaaggttaggaatcaccagtgatgatgagcctatgccaccacattgagctgagaagacagctgcatcttgggttcctgctccagcttaactgtgattaatctgtaaactggttaatttaccatgaagaacaacaaattaattgctatataataagctgaaaaattaaatggaattttcattttactattcaagtactaccacaagtagtaataactaatatttactgagtactttctctgtaccagtggctgagctaaacactctgcatatatttgcatagattatctcctttactcctcataatagttctgtaaggttaatgctcttttagcccaattttaaagctgggaaacctgaggcatgaagaaattattagcttcctctgcgtcatagctagaaagtgtttcagtgagatttgaacttgggtagtctgattccagagtgtgtgcctcttcacagttacgggaatctacctcctaaagagtgattttcactctgataccccagaaaaccaggtacgtatgtattgtgcagacatagacacaagttagagctatgtgttctctaacaaagaggtcttgagaaacattggagaaagcagccatatatttgaattggcacaagatcagttaaaggctggttcttctccatggattatggtaaaccgagtcgctcaaatctactgtaattaagtgaatataattctttcttagggattaaactgggtatgcaagagaacaacatgtaaaacatctgttcttaagatgcttctttggccctgtgtcacaactaatctacttagtgttataattttgtttccagatatatatatacagcattcagccacaattatgactaaggcttaaagtctctattatattaacctgccatctttaagtcttacagccagtaaggtggcttatctccaaatatgactcacacgcaaccatacttcctggtattcaggacattttgcaattccctcccatgttgaatctcactcttctcacaagatgacccagggagcccctcctgcaacaaaaatacatactttacagatagatttggggtgattgtttaccttgcaattttctgtttaaagtattatttatttgagttcttttaaatgttaagattctctccatttttattagtattaaacatttgatggagagacctggaggagagagcagagagaagtaaaactgaggccatgaaacttagcgttcaactattggaaagctcagtaaactcttcatgcagtaattcatccattgtaatagtacaatgaatgaatgactcttcatgcagtaatacagtactactatgatggatgaattactgcataagagtttactgtttatccattgtactactttccttttgctgctgtaacaaattaccacaatcttagtggtttaatacagcacaaattatcctacagtattggatgttagaagtccaaaaccatgatggcggcaggactgccttcctcacgcaagatctagggcagaatccattcccttgccttttctagcatttagaggctgcctacattccttgtctcatgacctcttatttcatcttcaaagcatgtcactcagcctctgcttctgtgatcacatctcttcttataaggaccatgtgatcacaatgagcccacttggataacccctacatcttgaaatccttaatttaatcacatcttcaaagtctcatttgccatgtgagataacatagtcacaggttctggggattagagtgtgaccttctttgggcagccattattctgttcactacatccattcccattcaatatattcatttatgcaattaattatgtaagcatttattgatacataacatatcaaacagtgagctagttgatagaaatgtaaagaatataaagaattgactacatgcgttcaaagcagcatgcatagaccttacttaaatacatggtaccaagtgaaaaagttagaaacaaattgagatccatagcatgataccattatataaaccataagagcacataatcaacacatattcaatacattaatacatattttacaagaacagaaacacaggatccacatcaaacccattataatggttgtatttgaagttggaagaggatggaagtaaagaatggggattgaaggcaacagtacatatgtagcaaaagagatggggcatatggaccaaagataatattgtgttgtgaaccaagaagtataactctacgctgtgaaatggatatttaaaaggaaaacaaacaaactacctttaaataataaacaaagtacacttatgtaaactttaatagtgctgttaacaaagtgggagaacatacagcacagaggaccacagagcaggtagaaggaggatgttgtagaacacttgttctcaactgcgatgattttcccccagaagacattagacaatgtctggggccattttaattttcgtaactgagaggtgggtgctactggcacctagtgggtggaggacagagatgctgctaagtatctgacgatgcacagggcagcccctacaacaaagaattgtctagctgaaaatgccaagagtgctgagataaagaaaaaccatgtgtagaacaaccagaaaaaaatccctgaaattattgtgacatgtcaatagatttgatttataaatatttgattatttgggggattaaaatataatcaactactcatcctctatgttctctctgctgggtttaaggaattcctttccaaacacctgatgcctattcttcatgaatttcagttcctgtgtctacacactgatgattactgatccctgattctccttacacttagagtttttagtgattccatggacttaaaaaaaatcaaatcataattggggttagaaagaatcaacaatcattgtttaattccattagttctatttgggttataagccaatcttcaaacagagaagagtgctgatgtctcacattttgacagtggctttggctcatgcaatcattctaagtttgaatattactgaataaattaagggtaaagtagagtaattctattcaggatctccaatctggtacaataattcaatctttcagtagaacagtgaagcagtgtctacttaataaatatggatggctaatcacacacatatatattttagccacttcttttcattatttagtgaacagacaaaacatgctaaatcactatacctctaaaattataaatttggtttgacaaagtcaaattagtttaatggtatgacatatatccctctagtctttccttttttttttttttcaatttcttggggcgtgaaaccatctcaaacctataccaataattctgtccattcatgacagatattgattgaccttgtgttagacaaagaaccagacatgttcaatagggagaaaatcctacacttcaatttcaatactccatttattcccagacctttacatgctgttatcaaaagacagttggctttggagccaaagacccctaaaagactacgggcaggttattgaaattctcaaggctttggtcacttcattgtaactttgttcttagaaaatttaattaaaaggtgaaattaagtgcaataaagtaggtaacacaaccattaattccttttccttgttctattcctaaattaagccctatcaatattaaagtgaatgctttaccttctgggtcaagccaagataaagcaattaggcaagaaagtactccacatcacttttgcaaatagttctatggtgtatcctctttggatgctcagcttaaatcccacaccagctgaacagaatttcttatctctttcgaaatccttaatattaattgttggaaatacttattttatgctaactaggggttgcccttagttctcattttctagttgattttcatgggaataagttttattttcacagataaaccataagatccttgagattaggaatctcatatctctacatccatctaatctttatctatctatctatctatctatctatctatctatctatctatctagttttgtataggaaacattgattcagacagtgccttcttagaatgcaggttgtgggaggaggcaatcaatatttctgaggaactgaatattactgccactagcttcaaagtctttttttcatgtatatgctaaattccaaatacttaaaaattaatgcacattaatatcctccagtatgatcaaattcagtgattcatgaaatgcaatcttctagttattaccatgttgaatcctcatataacctcaaagggaataaaaaactaaaaatacaacaaagcccagtggtgcccaatcagtaaacctaatgttagtatctatttagagttttgtatttaaagaaactaaatcatgggcaatatataaagttttagaaattttaaaaaactttgtgtatctgatgtcatattaaatttatattgaataatcacttttgttgtttcatttatctagccaatgcagaagttttaagcaagaaaaaaaagtcacattgaaaatatcaagaaggttgtagctgtaggctgagaagtataaatatataaggatgtcagttgctaaaaggtatgagtttcaagtattctgtctttactttcattttatatagctctggtcaatttcacagccccaaccagtactgaacagggaaattggaaaactgcagaattgatttgcagaagtgaagttctattttcttttacaccttcttcatcagagttgctatcattcttgtgttgtgtggtattattgagagtagcctgggtatagctgataattgctaaaagtcattctcttgaaatgaaagcagaaaaaaacaaggagccttcaatttctcattttccaaatttgatgctttcataatccttcatttttgctagaatttaaacgtaaaaacttttcttctctcaagcaaccatgattatagcaattctctttgcttgtgattcctaggtaaaaaaaaatattaaaataataaagctctaagtgtctaatttgaactaaatataggaccttcaaatattctggttcagtttttcagtttccatccttaattgattttactttaaactttaaatataggagtaaattgcaatatagtacttaataccttaagatgaaaactggtttacttttgctgctctttccagatgtgcagtagattcaggaggtttttactaaaattcaaattagaggtgtttgaaaacaaagctgtaacctttggctatttagtatcaatcctgaaaaggaatctccccagtattcttacagatcattgagaaagaattgttgtggtacaactgactgaatttcgagatcctcctacatattctgtgttttttaaaaatgcattttagtgatgattaaatctttactatgtaatgccatctgcccagtagaatggagtccatttacagtgtcatataaatggcaactttttacctataattttttttctatttatttttagattggcttttgttctttgtattctgctgcatctccaatttataaatctttgtgggtcaaagaatcagaacactgtcttctcactaatcaaacaatattgtcaagtctgtttgttactaagttgagaattgaatttttaaaaaattggccaagtttcttaaggcttaaatagatagatggctacaaaacaacaacaaagcacaaacaaaactcctctattttaacagatttgaaaaggttgccagataaaatacagaacacccaattaaatttaaatttcagataaacaacaaatgatatttcagtttaaatatttctcaaataatgcatgccctgtatttttatttgcaatatcgtcagatgttgtcaaaccctaaggattaacgccatttttttcctcaatactaaccatattgtcataaagtgctaccattttaataaattagaaagcaacatcataaaaacgaaaaaataaagttatgagtaaccaaaattaagtcaatttcatctatccagaaacgtgcatacaggacattcacaaagaagaaattataagtgcatatgtatatgcagaaaccccagtcatgaggaaacaccacttcctgttaacttgcatgggattatagtattttaagttctaaatttctcagcagacctagaagacagaactgaattgtttttcataattatttctctttctcaatcacaatttaaattccaagatcctttctttatcaagaagttcaacggtttgatcttttcagtgctagaaaagttatgcacacgggctaactatatgtctactagaaattcttcccattcgctgatacttccttacattttaacatctagaaatagcattcccaatgttagctcatttgcaccttacatttatttttaaaatatgaaacatctataatgtgccaggcaccccgttagatgttagaaacacaagatgagtaaataaaaattcgtcaacagtaaaattttgattttctttccaaaaggttgcagcctatgaaatccatggagtacggattactattacttcacgttacagatgaaggatctaagcgctcaggggttgaaaggtcttatgtcagttctcacatatagtgactaaagagccagggcttcagtaatcatccctggctccgggctcagggcattccggtattttttcaaaggaaattccggaatacttagtattgtatcccctccatttcccaagagcaaaaagtaaagcatcttggatccccttgtaatgttcacgtgaggaacaggtgttctctgggtgtgctagaaaagcaaggcaccagtgggagttgaagatcctaagcagccgctgtaaccagaccaagttaatctgtggaaaccagagcacccggccaaggcgatgctatttcaattgggtgtcataggtgactcatcagagacgccttgcttttgggccttgtgatatttttcttcagggtgggacgtcagatttcctttgcatttttggacaacagccctcctgtccatttccacatttttctggttttacagctctcacgcagagcttgatttcataccggaagctagtcactggcaggaagtttacggaagaagaaaaaggtaaaaaaatgtgccgggggccaggagagaggcctaaaatggggaaattcgcacttgaagagctttccctaccccagcccctcagaatgacagttctcctccgccagaagactacctctcccggcaggcactgcgcgctcgacggccacaggctggccagctccctgctctccacctccatccgaatcagccaataggaattcccggcttgggcctccgcccgacccggaccacgcgggagccggggcaatcaaactacatttcccgacacgcatgtgctcgcgtcgtggccaatcagcgccaggaattcggaggctaggggtggagccagatgcacaggacaccccattggccaggggaagcttagaagagccggaacccgggagctagagaagcgaaatgacatttcctttttaaatagctggagtcggggccccatcgagaaatggccgcgtcggcaggtgggtcgtgtggtggccagggcggcgtggagggaggtgagggggaaggtgggccggggccggccacaggcagtgggatgaggacgtagcggtgcggagctagagggaaggatgaagcggtggaggggaatgagaagagggaggatgaatggtgcggagggcggtgggcggtccggcgggaccgggatggggaggctgggtacccgccggcgctgcgccccaggaggcagcgggaggcggcttgagggggcaccggcggccgccgttgttcgagcttccctcgtgaggctctgccctcggctctcggcggagtccgcgcagacgcctctcctgggctgcgagcgcgtttcctccgcgagcacgggtgccgggctcgccgggctccgcaggagcaggctggcctttgaacttgttccgccgatcgcgctccgccctctgtctcccagatccttaactcgcggtcccacgaggtcgtgcgtatatccacagacatttgtatatatcttgtagggggaaaaagcctagcaagcagacacacaaacagaaaaatcccgcgatgccgtaactggctcggcacttcttgtagttgtacgatttttctcctcctagatttaagtaagtcttccccaacaccgaatgggattccatcttcagacccagccagcgatgccatggaccccttccatgcttgcagtattcttaagcaactcaaaacaatgtacgatgaaggacagttgacagacattgtagtggaagtggatcacgggaaaacattttcctgtcatagaaacgttcttgctgcaatcagcccttacttcaggtatgatgatggtaggaacttctgttggtatctgcaccaagctccctttccccctcagtattgtccacttgatgtttatattgagatgcgataatgaaatgaaaccaatgactttgtttcttgagactagaaaacaagtcctctcttaactaagaccttcttttgacttgagggattcttctagatttcgggtgattgctttttaagttagtgggcctgtgtgtgtgtgtttgaggtaaatgaccagaaaatctagacttgtgctggtcagtatggaagccagtagccatgtgtggctgtttaaacttaaattataagttaaataaaataaaacatttagttccccaggtacactaaatactttttgagtgcttgctggtcacctgcagctagtggctgccatattgggcagcacagaaatacagcattttcatcattgacaattttattggacagtgctgatctagaatttctttcaaaaagttatccataatgcatgtttctttagtgtatgggactcttttataaaatagtttaaaacatgtagcatgttccttcaaaaacaaattaccactcaatagattgtttaaatgctatgggggtcaaagcaagaatgaatatagtttctttgtgcctaaggccccaaattaataatatccaagatttctagaagtatgttaaacgaagtttttgtttttacttatattgtctactataaaacttttaaaagtaaaatttaaaaacttgggtctgaaaaataacttcctactttaagatgagtggaaaaggcagttttctgcatgggcttaacttcttttgtgtcaaatgctcactttaagcctttcagtattcacaagtggtgcataaataatagtaaagttatcaaccacactctgaatgtgatttttccttttgaaggtgcttacctttatagggcacataaccatataatgttccaacagtagtttctggttcctctttctcagaatactgggttaaatatagtcacttcagtctgatgcttgtgatgtaaccgtttagacttgcctagggtaggtcattggactactaagtattaatcatcgcaagacagtgagctggaaagaaaaaaaaactcacatatgcagaaggtatgaagtttggcctggtaatggaaacttctagtgagattcacttacccagattatctattagatatggttaggtcatttgtatgtttaaatatatgtcacagttactacttatcaagctctaggctaagcttactttacatgtattgccttatataatctttataatcctatctctgcatagttgttgttccattttacttatgaagaagctgaggctcagtgagattgagttttaataacctgcctaaatcatctatccaacaagtaaatggcagaggctacatttgattacagagccaggcttcttagtagccatatgactcttaaggaacaagagttggtacagtttcctttaaaacatttttattgtatattgcatttgaatagtaaaaacaaaaacaaaacaaaacaaaacaaaaactgcaaagtaaaaatgtctatatcttactgaaatttaataatctggattatatcatttaaatgtcatacttatgtatgcttactaagtatacttattaagtataatacttagtaagcatacataataaatatgatatatgtatacatattaagtatacttattaagtataatacttagtaagtatacttattagtaactttacataagtatgacattttcaccttgcagtttcattttttatttttgaagacctggaaaaaaattttactttaaaagaagtatgctatgatagatttctaattttcttgattccttaaaatcttaaattctttaattttgttaagtcaatttttaaaaggagtaaaaaatacttgagaaattttctggggatacgatatgtgcattgaaataaagatatttggctagaaacctcaaggattagaatttgatctcttgctagaggtttttgtactgaagtttcttggtaccagcgctgcttcctgtgtgggatgtagaaaatcgtacttaatgtttctacgtcttgcatcactagtggaagaattagaacggctggaaatctggaatggctgtttcatgataccagtaactcatcagaattgaaatttgtatgattattagaaattttttgctgctctggattttgtgtgaggaagtgccctggcttcatttatgttgagtttacatgaagaacttactagaacagaggaaaactcatgaagtgtgagaccactcctgtgtgtaagatgagcctattcaagtcagcagtagttcccatgataaagggatatgtggtaatgtcttcctttgggagttaatgtctccctaatgcagggctttatttttctttttaattggtagctgtatcggtgagtctttcagcacctgaattgaaaaccagcacatacgtaggaacatctagtttttagtcatcaaaaaagccagtgtgatactaaattaaaatgtacattgtagaagtaaaaacaggactcgaagatgattaacctgggcagcaagttgagtccttgtacctccagtgtttctcatactgcattttaaaattaattccatgaatttgagagatattttttaagtgactggaaatctttgcaattcatttttcataagatcacaaaaattaaataggatgagtctggatcatctagaatgaaactttaaaggagcgaaaagaaaggcaaatgatgtttgcaagtgactaatacttaaagagccaggctgcttaatgtttcggtcaagaaaatcccataaatgcaacaatattttaataatagaaaaaaccaacttggtctcgaaggtaaaagtttggggttttaaaaaccattatcttcaaagaatcagttaactattaaactctgtttaaaacaggcattatgtattgactctaccataatctttatttatgtctagatttaggtaggtaaaatatggtatctttgagaaaatgaagtatttccttttaagcaaatgttctcaaaatttccaagggtaagtgaagtgattattatattacttataatggttaaggcagcattcaaaagatgacagttttaaaaaggagtaggtggagaatatgtacttttaaagaacttcttgcttttctaagatgaacattttaaagatatattttggatacaagttgccttgtaattttcaccaggacatgaaaagtttttattaggttgtttctttgtatgctaatgtatcatgttgatacctttataggtattcttttttttttttttttttttttgagatggagtctcactctgtcttccaggctggcactcagctcactgcaacctccgccttccgggttcaagcgattctcctgcctcagcctcctgagtagctgggattacagggatgtgccaccacgcccagctaattttttattttagtagagatggggtttcaccgtcttggccaggcagattttgaactcctgaccttatgtgatccacccactttggcctcctaaagtgctggaattacaggcatgagccaccacaccgggccagtattcttaagctttctgactggcatggcccaatttaagatctgatgtccctaaggcaacttgaccagaactctggataggggcttctaggaaaataaagtgacctggaatatgtgtgtcaccttttgatttgcatttacttaggtgtactctccttttttcatagttggcacacagcgagctagccctgagaatatgggttttgaggttagccagactaaatccttctgatacattatcaatttttactcctattcagaatatcagggactattttaggaaatattctgtttcaaaaggttatctttgtggtaactttgtacttttaaaatcttgccacaataattttgatttatagcacacgtgtaatattaaccactctttccttcttagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggtaggtgcctaagtgatttagtttttcatggaagggtaacacatcaagtggtggtttacttaattatactgaaacagttgtgttcccgttaattgaggaatacctccagcttccttatcaaactattggaacagtctgttctgtaaagagctataaagaaaataaactcttgaattaaaaaaaggcaggtattgttaaattactaaaataatcctataatttttaatgattttgtgtcttgatatcatgtagaataactatttttgaaaacattctttaataaataatagttcggcattttgggataactatttcagagtagtttgtaggacttgaaataaatagcaaggttgttacatggctgtttttgctcttgagtaaaattgagatgttgtagcaactggtattctgtggaatttactggattagtttaaaagagaaaagaacaaagcattaattaagttatactatttagttaccaaagagttttatataagccttattattgcaaaaattatgaaatttaattacaaagagtttggaagtatggtcttcaagtttcaccttcactgctgtttatgttgcctttcataatacattttcaatttttttcaccggaaaactttgagatgtcccttttttttggtttgccattttaagtgggactatctgatatatgtagtgtttgttttgttttgttttctgtttgtttttttaactgttaaggactactactttggcaaaaatacagtagaggtagagtgactgagtcagagtaaataagacatttgattcaaggctctgatttgtgataactattttccttttatttggtttcttacacattttagttgcttgaatgtttaatgcagtgtagataatagcaacatccttattcctcgtatgtgtctcttaattgatgtttttctcacactactacttaaggaaaaggagcagcttctatgaagatatacagtcatgtgccatgtaatgttttggtcaatgatggatcacatacacaatggtggtcctataagattatgatagcatatttttactgtacttgttccatgtttagatatgtttagatacaaaaatgcttcccattgtgttacagttgcctagagtactcagtacagtcacatgctgtacagttttgtagcctaggtgtgtagtaagctcccatctaggtttgtgtaagtatgctctatgatgttcttcccacaaggacaactatcacttaatgatgcatttctcagaatatgtccctgtcattaattgatgcatgactgcccttatcccattgttttctttctttcttctttcccctcccccttccccttcccttcttttctttcatttctttctttctctttttttttttgaggcagggtctcactctgtcacccaggctggagtgcagtggcatgatcttggctgacttcaacctccgcctcctgggttcacatgattcttccacctcagtctcaggcatctgccaccatgcctggctaatttttttatttttggtagagtcggcgtttcactatgttgaccaggctggtcttgaactcctgacctgcagtgatccacccaccttggcctcccaccattgttttcttttaaaaattgtgttccttgctctaatcctttatttaactaaaaatttcctagtaatatctgagctcatttgtttaagttcagtgtcaagttaattcctcagaaggagttgtactctctggttccttattttagttaaatagaagcacaggccatgatttgggtttgctgtcttgtggaaaaatggaatataagaatggatgtatgatccgtccagtatacttggataggttatgtcatccagtatgatgaagctgtctgtgtatgtgtgtattttggtcttactgcctaactgttagttggtagaggtagaattagattcctatttggaatgtgaagtttgtatattaatgcaaatactaaagcaaactagcaatgaattaatagaatttcagggctggaattattaacatcatttaatttgaggttatattttatataagaggactctgaagccctaagggtttcttaattgcatattattagctttaacttttattaaagagtactttagattttaacattcaacttctttggtgtgtcgtctttactttcttatctataagaaatttatagagaagtagcacacattacaaagtttaaatttcctaccttatttatcgagaatcctgttacaagttaggcaataagggcagatgatgtgcgagcaaatctgggagctttacaagctattttaagttagttgaaggcaaagcatcactgttacgaagtacgtagttgaatttgtagataagagtaaccctagttcaaaacagttttcaaggggaagctcaatttagaatctggtatttctaatctaaacaaagcctctttacataaataaacctgacatgcatagtcagaagcttatgttgtactatctgtggctattgaagtatcatttaatctgttcataaagtgttcagatttttattacaaagattttaaacaaatgctataattagcaaaactattgtaaatcttcactactttaattctttcagacattttcatattggcagtctgactcagcatacctttttattatcaaatcaaaatagaaactgactcaaagtcaacatcacaaaccatgtatgtgttttctatcttattaaagtcatgttttctcctgctgaatatttctctttgcattatagcaacattcaggtaagcacatcagtgacccataagcataaatctgcacaattccatctgctgtcttctaattaaatagcatacacatttatcatggcatatttatgatgatgttacatgtatgcattttggtcttactggctgaacgttactaataatgcttttttagagctagagtaaaatgaattttctataaacacacaaattggatagagcaaatagaatcaagtttgtgtttttttttttttttttgagatggagtctcacattgttacccaggctggagtgcagtggcgtgatcttggctcactgcatccttcacctcctgggttcaagtgattctcctgccttagcctcctgagtagctggaattacaggtgcctgccaccacacctggctaatttttgtatttttaatggagatggggtttcaccatgttggccaggctggtctcaaactcctgacctcaagtaatccacccgtctcagcctcccaaagtgctgggattacaggcgtgagccactgtgcctggccagaatcaagctcttaacaattctgccatcaagcccaagtaactccttgtaccttcccaatacaaacctcccaattcaggttgattataatattatctgttatattgtgtcatggaatgacaaagttttaaggtattttgtaacccatatgaatgtatctctggagattataaaagaaatgttttagaaagtgaaatatatagcaaattatgccctttaatctttagaggttgtagttacaacatataaccaaaaaccaaacataaaaatttacatattcttgttttcttttttttttttttaggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaacttccagtgttgcaaagtgatatctgactagtgagtgttgcagaattaaaatctggtaaaaaatcatgaaataccttatgtcatgatagaatggaatgagattttaatctattgaatacctgtcctctggtaaaaaatgaactactttatgtatataatactttttaaattctaaagcaagttagttcacttatattggtaaattctttgttctgtttgttctggcctaaaatcttgttatgtttgactcttttgtgttggtccactttgcattaccgtaaaggaatacctgagattgaggcctcaggaggctttagctcatggcagagggtgaagcgggagcaggaaagagagggagccagagaaagttgggggaggttcctgtctctttaacaatgggatctcacatgcgctcattaccatagggagggcaccaagccattgatgaagaatccacccccatgatccaaataccttccactaggccccacttcttccaacactggggatcacatttcgacatgagatttggaggggacaaatgcccacactatataatctcttacgtatttcatgtttaattcatcagaaagtcccgttgcttcttccttcataatacatccagactcagaccacataccatttgcaccactgtcaccctagtctaagccagcttatcttatctgacttaatgcagtttccactgactggtcttccttctatcacccttgacccctcataacctattcttttctccacacagtactcagagtgatcctcttaaaacacaagtcagatcatgtttctcttctgctcagatccttccaatggcttcccatctcccttcatatgacagccaaactccatacttacatgatccacccctctcaaacttgttgccatttacttggcttgctctattttagccacactgaccttgcttgttgctcaaacctgctgagcacctccacagcgactttgcccttgctgtctcttttgctggatagatcttgacaactcactcactttcttttttattaaaacatcaccttactggagaggccttctctgatcacattttgtaaaataagatcatccaaccccacccccatcatacctcctgctttatttttctgctttattttccatatgtgtcttcccccattgaaatgtacactccacaaaggcaacgaatttattttaattcactgttgcactttagattgatgcctagcacatagtaggcactcaatgaatgcttgtgggaagaaatgaattttcagttaagtcttggagcctaaaggattaccaattttattggtcttttcaaaaaaaaaaaaaaccaggtttagttctaatgaattttctctattgttttgtgttttcggtttcattgatttctgttctaatttttatagttttttttcttctggttgctttaagtattaataactcatctttctatttcttttcttttttttgagacagggccttactctgcccaggctggagtgcagtgacgcaatcttggctcactgcagtcacctccacggctcaagagatcctcccacctcagcctcctgagtagctgggactacaggcgcacgccactgtgaccagctaattttcattttttttttttttttttttttttttttttgttaatacggggtttcaccatgttgcccaagctgatctcaaactcctgggctcaagtgttctgcctgcctcagtcttccaaagtgctgggattataggcatgagccactgtgactggccttcttttcctaatatatgcatttaatgctataaattttcctttaagtatttcttttgtagaatcccacaaattttatttagtattttcattttcttagtacaaaatatttttatcatgtcttcttggggaatataccctttcataattatgtaattgcttctctttatccttgataatcttttttctgaagtcttctctgtttgaaattaacatagccactcaagttttcttttaattactgtttgcttcatttatctttctccatcccttctcttttaacctatcctaatctttatacttaaaagggctttcttgtagacaacttacagttgggacttattttaatatccattgtgagaatactggtatgtttagaccagcattgcatttaaagtgagtactgatatagttgggttaatatttaacatattggttattgttttctatttgttgcccttcttctttgtttctttttttcacctattttcctgctttctctggttttgactgagcattttatataggattctattttatctcctcttagcacttcaattatactttaatttttttttcagtggttgcattagacttacaatatacatttcaaaactaatctaagtccacctttaaataacactatactgcttcgtgtgtagtgtaggtatcttagaacaaagttcccaattttcccctctgatccctcatgacattgctgtcattcattttagttatccatatgctataaccatgcaatacattgttatgattaaagtcatacttttagatcaattgatatttaaaaaataagatattttacttcatcttcacttattccttcagtattcatttatttaggcagatctaagtttctgttctgtttcaattttcttctgcccaaataacttcttttattgggcattgcttgcaagacagatctgcaggtcatgaattccttcagatttttgtttgaaaaagtctttatttctcatgtttcaaggataattttgctggatctagaatgctaggttagtgggtgttttgcttcaactttgtaaagtgagtagcttctaattaaatatcagtggtttggtgggcctgtgtcttggggctgtgatcttcacaggtgtttctctagtggtacagcttttggttttcccctctccatcctctttctggctgtgccattcccaattttatttctttgaagccctgacccatgttgattaaatcctttttcctttaggtgagaagagaaggttagagaggtttgggatgggaggaatgctcttccccctgcttttgttgaactctgccaaaatgtttttccgtggagagtatgctttttaaatggaaaaggttctgggtgtatttcatgatcattactcttcctgtcccctagtcagagccactaggaggtttgtctcagatctttgccatgagaacctggtagagtgcctgttggtaaaatccacagaagcgtaggggccccaaaagactgaagttcccaggagttttccactttcatgggagtccatgttcagcctcagcgattcatcaaaaatgaccatttaagtgttcttacagtttacggctctggttacttctggtcaaggttagcagatctggactgtgactctgaattcacctctaatccagggtaacatttgccctgcagcctaatttctctgatggatctaataaaagtcattgattgtcagtttgaatacctttttcttccaaggttaggaatgacaacatccaggatctttacattttcagtgctaaatgtggaatcccctataataagcttctaatacatatttttgattgaatgattcttcagttatgcataaatatcttatgccatcttttatatgtataatgttttttaacaattaaaaaataagctaaaaagtctcacttttaaaaacctatatacttaatcatatttaggtatcttttatttataatttatacggccatgggattatttgacatgtagttcagtgaatgttgactcttgagtacctaataatccatatttcttgcaccaaattaaaattatataagttaaaaaaatcaatcattttaagactttttttcccaggctactaaaactaaatagaaaattacaatgtaataattttaaattatccttatcatggatagacagaacattttctattggctagttttttagaaatgagatttaatagatcctttttctcctttctttcctcttccataaggatatgcacaattatatgatttggtgaatcaaacactataatattaagtaaaacgtggaatatattttctaaatattttatattggtctggtcaacatgaattatagtgttttccgtgaccgcaggtagattacttaccttttctagctttactttttcatgcataaaacaggttaataatctaccacgttatcgagtttttttgaggatcaaataagcatgtgaaacacttatcacagtgccttatcacagcacataatgaacacttcctaaatattaatttgttgaaattattaacgactattctgcagtcttttagatatacttaaccattgtagaacaatattccttaatagctaatataaagtatatattaaagtgtagccatttggactctgattgtgctcataagccatgcatgaaaacaatttttacagttttacagtcacacagttctcactttcatttctggactgtgcatttctaaaggactgaaattaaaccaatggtatttaaaataatttaaacaaggcttgtaacctctgtctgcaaaataaaaataatgctttttggcttgtctatttttacaaactgacaagggcctgtccttagagtttatcttgttctctgttcccattcagagataaggacctgtcctagtcagttcaggctgccataacaaattgccataggctgcatggcttaaataacaaacatctatttctcccagtcccggagtctggaagtttaagatcaaggtgctggcagatcctgtgtctggtgagggccctcttctcatcgcatcctctcatggtgaagagcagagaaagagaaagataaagcaagctctctagtgtctttttataaaggtactaatcccagatccctcatgacctaaccacccgcaacggccctacctcctaataccatcacattgggggttaggattccagcacatgaatttggcggaattggcagaaacattcagttcacagcaggatttaacagagttgcggtcacatagttcagttcttgaaacacatgcttgcaaaatcctttaaggataagaagataaggtcaaaacatcttatcccaacacttagattacgatgtcaagtagccaaagttaagtcttgaggagcaaatgccaacaggaacccacacaacgcaggggagtatttccttgtaatcagtgagaacctgagatagtaagaaatccatggtgctctctgacaactgttcttaaagctcaagagcttggtcaaggttagcgatggaacttaggagtctggcatatccacagagctggttttagttgaatttgagttaatggatgagttagtgcaaagataaattgtaaaatgagaagcgaaagtagctaagaataaaatttaagaaattcagctgaaggaacagaagaaaggcaactgaaaagttatcagagaagaagggagaatcacaaaggagtagtaatgcatgagaaaacttcaggaatgagatccaaagagaagaaatgaaatgcagagagtaagaggctcctggtctagccatgtgaagatctgaaatgagaaagtggttttagccaagtgcaagagatgaaaaccaattgctgtgaattaaggtgcaggtggaggatgtgagtgggtgtcagtgggtgagagtgcaggtgcttccccaggaagcctgcaggtgaggagattctgagacgtggaggtgctggagaaataatatttttttaaaaatcagaacatttaggccttttcaataaaaatgggaaatgagaaatatccttgcaaaaagtcaaaatcttttccatttctagactattcccggttgagagttctgcagtatacccgttaaccccaaaagttaaagagattagggatatgcaaaaacatgcaaagaggcaggactgatgaaagacaaacccctagaaataggagcagagtgaaaaaagagaaaatcctgacccagagagaggtagacacactttctatagcctcttacatttctgaaaaagaatgaaaatagtaagagtttttgcaacttcttgctactttgccccagagccaaatatggttcccacccctgacccaaaacatctggtttgtgataagggctcaattatcctgtgctttctaaagtatgtggtgggtgtggtgatggcaggagtcaacaggcagaagaatggatgagctaatcagagcatgcatacgtgaaagtaaagaggacaagggtcctctcacttggtgtttgtgtagctggagatgacagggagatgacacctatcactcaggggcctgccccagtgagtggggagtttcatggatctcacctcaagttgtacaagtatatgtcctggggcaattttgattcacaatttataaaatcatggtaggattttataattttattttataactttaccctatagctgcaggcagaaaaaagaggagagtaattttgatatgtgtatataggcttttttttcactttatatgaattgtttattcatatcttttcctcatttttcctttttaaaatttcatttaagttccgggatacacgaggtttttatattcatatataaatgtgatacacagcaaaatacttgcatcagtatctgtgtatccttcttgaaggtttctaagaaattggttataattttctttttaatctacattttactattccaaaaattaaaatgctatccacactttactgggcactgacctgtgtgaggttgatttccatggtagcatgaaaaaatatatctatcctgttttgcatgacaaaacatatctatcatacttacatatatgataacaacgacccatgtgaaaaataatatctatgagacactgactaatatcttattcttgcatatcactttctagtttttgaaatgctttggtatctgttatctttttggttcctactaccggtgctgcagccatctgtcattgtcccccttttacttttgaagaaacaaagaaacagaaaaggagttgttaaacttagggatcaaacttagctgtaaatgaaagcagacctgttaatttcctcccactccctagtgagcagggacccaggaagatggcccgaatggttatattcaaaggcagaacgtggaggtgctgggactgcagaccttcttgctggtcaaggagccagtttgggatgtaaagtgagtgagttcacttttggaagagctgagtttcaagtgacagaggatcactatgtatagattactgtgccgagaaacagccaggatgggtgtggagacaggaaactgaatgaaggtgataggtcaggcgaagatgtggagttggcagtcacccaaataccggtcagcgctcaaggcacttacagagggaacgagaagagcccgggtgagagccaagcgtcggagggcccacgtgaggacttaaggaaggggaagagagcatttcaaagagccaaggacagagaggtcctgggagaagcaggagcatagccttgagaaaggaaagaggctgcatgtgaagggaaaacttggtgttcagaatgaagacggctcctgaaaactcagttcaaccttttgttcatcaaatgttcactgttaagtgcaggttttaaatttggactctgaaaaatggtttcttcatatagaatagtgatatgaatgatttcattcactggaacatctcaccgcctaaccagtgactcagaggaactttcctctgttaatgagtgtggccttcctctccgctcacccttctgcaccttgacacgggacactgctcctcttctgtgtctgagtctgcttggatttgaagctccccaagggcaaggaccctttatctcgagtgtgtactgagcgcggatcatggtgcttgacagacaggggtccctcaaccaattcaaggaacaatggcatgaatatcccgcttctgctttccggcggtttagttttcctctctgggactctctgactccatatttcccgttgtttggaaagatacatttgcaggcttagccgtgattggcaaacatttttatatggggcttggcattttaacatctggaaaagttgtgaaatcaattagctgcagataaagatggacagatggaaatatctggtggttttctgcacatcggctatgcaaataatcagaccattgcttattgtgctacacttggactctgttttaccagattttaggaagagtattgttttttgttttggagcatgagcactcagtcaggacatagaaataccatctcctactgaaaaggggactgggtgtaaacgtggagtatttatcagtgtggagttttcatacacttttccgacaggcttatcaaatctctctggaaaatttaggtttttgtttcattcaaacaatgatgcagttgcattgattctattctatcatgtatgtatggtggaggagggcaaagaaagataaaattaacagactggagaaggggatgagaactaggcgcttgaaagggaattgttaaacttgctggatcaaactttgctttagcttaaatgaaaagagacattttatcaatttcctgtgagtggggacccaaaaggatggcctgattggttatattcaaaataatgaaattatttcccctcctacatctgagttacaatattaaagctttgcaacctgctttgtgctgcatatatatcctttagattcctagatgggcttccacatgtgattaaaaatgctcattcccctcccttccctcatctctgctaatatatattgaagccactgtgccattgctttctagcagccagtgctactacggataagttgcaggttattctgtttccctgacctttgtaaatttcctctctctttttctttttttctggaatcttatagaatcttctattttcctttatattctgaaatttcacaatatatgcctaggtttatggatttttcatgtgatatactggcactgggaaattctcctgtcatttatttgataatttattcccctgtgttcttgcttgctttctttctgaaattcctattagatattgaatttcttagatatgtttgttctcgtatttctctgtttctcaatctctttctactttctagaagattttcttgattgaagttttcaactcttctaataactcagctactgttttttttttgatttgcaagaagttgtttttgttttatgattattctttttatggcaatctaataaatattcttttcttatgcataaaatattttcttgtatttctctgagaatcctgttttccaacattttatcatatcaaatttcaaacacaaaaatgttaaagaattgcatagtaaatatcaatatacttatgacctatatcccataattacatgctgcaatttttatatatttatttaatcacatatccatctattcaatgaataatctttaaaagatttctgtttcttgtgctctggattgtctccatttttttcaagattcatttcttttattgtttatttctttcttatcttccaggctgatctcatctgtctgagttcctagttacccactcacatttaagagtaaaatcctaaaactcctgaccatgcccaccaagctttgaggaaaagaagtggatccctgactgctaccattcagtgtgtcaggaaggtggaggagaatggattgtctcttctctgtatagatcttcaatcctgtcctgtgttcagtctcattcctcaccaatgccttctgccttccttggcacttttggtcccagggtctccaggatttggtggagtgaatcagctttcttctcattcatagccccctgtgtactcttcaggtacgggttcttccaatctgctaaagctactcctccattttgttctcctatcttgccaaatttggttgaaatattttcacagttgtcccctatcacaatttttcttgtgcatttatggtatgtgtgtatatacttgcatatgcatatatatgcatatataatatagtacttgcatatgtatttgcaagagttttgaggatggtgaggaaaaatatatacttggtttaaagaccattagaaagctgtctcttttgttgttgtccttgagacggagtgtcgctcttgtcgcccagactggagtgcagtggcgcaatcttggcttactgcaagctccgcctcctggatctcagcctcctgagtagctgggattacaggtgcccaccaccatgcccggctgagttttgtacttttagtagagatggcgttttgccacgttggccaggctgttctcgaactcctgacctcaggtgatctgcccaccttggcctcccaaagttctgggattataggcgtgaaccaccacgccaggcctgtctttttcattctatattgttttgctttatcagttgttcctctgtttctatgggttctgtattcagggattcaaccaagggtggataaaaatttttgaaaaaacatggatggttgcatatgtgctgaacatatccagacttttttttcttgtcattcttccctaaacaatacagtataactacttacatagcattcacattgtattagatataataagtaatctagagatgacttaaagtatacaggatggtgtacatagctcataggctactactaagggacttgagcattagtggattttggtatccgtggggtcttagaaccattccccaatggataccaagggacaactgtgtcttcaagcaatatgttcatacaggtttgtggatagtatactctttgaatccttgtgtgccagaaaatgtcttctgggtctcaccttgccagagaaagtgaggcctgagagcatcatatgggggtctgtcagtgttttagctggaggacacagctgtatagagacatacgtagaataaaatagttgtcaatccatctaagacacgtgagttgccattcgaatccaacttcttaccaaagtggcctcctgaccctcaaatttcaggagtttccctagcacaggttctaaacagtacccaatctggcagcgctgacttgtagaacaagggatccaaacattcgaagacaaagtacagagtagccaagatcactgagtgactgtggatatgcatagcccaggtcacttttctctcagctcagcagttgaatggctgaatagagactatgtgccactaatatataactttcatctcaggtttgaaggggcagctttggatggttcccaggtaaatgccagaaatgtgaagtcaaggaaatatcccatgctacgattagctggatatatctacattttcttcaacagtaagtgaaagtagcttgaaagatcctctaaaggggtgatgatgtgtagggtgggatataagaaggaagccaggtgggatataagaaggaaacatcatcatggaacccccattgcacatagagaatgaaaggtagggaaacaaaatgcataggcttaactaacacaggaacagaaaaccaaacaccccatgttgtcacttataagtgggagctgaacaacgagagtgcatggtcacagggaggggaacaactcacactagggcctgtcagtggggcaaggggagggagaacatcaggataaatagctaatgcattcagggcttaatacctaggtgataggttgataggtgcagcaaaccaccatgggacatgtttacttatgtaacaaacctgcacgtcctgcacatgtatcctgaaacttcatattaaattaaatttaaaaaaaagaaaagaaaatgcatggcttgccatttgtatttattctgaactggatgcctttcctaggaaaaatgtctaaaattgctagagggttggtgggggagaagagaagcaatgatcatctttgtatgtgttgaccaagtcagctcagcagaggtaaacactgaattacagaagggcttgtaacataggaagctactctaacgtcatgcttactccgaagtgaaaaatgccagaaactgagggatgatgtttcctccaggtcagaagatacagctgatttgatgagaaagtacttaaaaacaagttatccagattaaacctagtaacagataattgctcccccaaatccattcctactgtgttcttgagtcaaacagttgccaggataaactgtacatacacataaaagagtaacatgcagaaagaaacatccataggatctatacattgataatataaggaaagagacagaggtgggcagtggggaagagagagagagacagacagacagagagagagagagagagagagagagagagagagagagagagagagagaaacatattaaaaaaatcactccaggaaacaaaagaaaatttcagacacatactaaacaacactaatactgaagctccctcactttgaacccttgctctaccactccctggcttgtgggatctttggcaaattacttgaattttcagtgtctccacatttttaacaagaaatgacaatagtgccttcgtcataggtttgtgagaggattggtaagataatatatgtaaaacatttgtaaagcttttggcacataatagtacactctctgtgttagctattattcaggagcacacagctgacattctcatatcaaagaagatggatattatgtagaaaaaagagatcaaacaagtgataaggagacaaaaaagaagatcaagatggatctggagaactctctaaagaaatgagaactaatcaattcattgcagaaatcagtatttattaatagaagctcaagtagaaatgacagctgaaaacagagccaggggcataagaaagacttctgaaaaaaaattacaccagagcaaaagctatagtctcattctgatagacatgaagttcaacaactaaagtgaataaaatcactcaataagccagaaacataactaaatttgctctattaatgaacaatatcttactggaaatgtatccaagcatatgtattggaataactgtatggtattcctattaaaatcagaagaaggggtactgttatttatccctgctctggtaatgctaatgattgaaaaattagacaagttagcaaaatgagaatagatttttgtggacaaaaaagagacaagtgtatgtgtgaataattggtttgcctacctagaaatctaaaagaatcaaatggaaaagggtagaactaattatacagttctgtgagttaggcagagacagtagatgattgctaatacaggaatcaaaacttgggcatgccaacaaaatatctcattttaaagttatactcccagtgacagttaacaaattaattcatccttttggaggatagtctatcacttgtcctagaatttgtcctggagaaattcagcacatgtaaaaacatttatgggcatatgaatagtaactgttgtattatctgtaatggtacatagaaatatgtgttttaaatagaaagattattttaaatggtatatagaaagatgtgtttaaaatacaaataactgttgtattatttgtaatagtacatagaaagatgtgtttaaatagtacatagaaagatgtgttttaaacatgtatttttgatattaagaaaaaatattcattgtataaatgtatcccatttttatagaaatgctgtgttcacatgtgtatcttaagtctatctgtgtacctacactaaattctcaatagtgtttacttgcagagcctaggctagacaagtgctgttattgcttcatttcttcattttatacggctttgtttgtttctgagtgggttttttaattttttaattttttaaaaaatttttattttttgagatgaagtctcactctgtcgcccaggctggagtgcagtggcatgatctcggctcactgcaaccttcgcctcccgggttcaagcaattctcctgcttcagcctcttgagtagctgggattacaggcatgcaccaccatgcctggctaattttttgtatttttagtagagacagggtttcaccatgctggccaggctggtcttgaactcttgacctcgtgatccacctacctccatctcccaaagtactgggattacaggtgtgagccaccacgctcggcctcatttttgtttgttttaagctaagatactatatgacttattacataaattaaatgaagctaacacccaaagtccctgaatttgaacctcagctctcctactcactggcttgtgtgatctttggcaaattacttgagtttccagtgttttggtttccacagttttaacatggggctaataatagtagctgccacatactgctgttagataattaataagataatacatgtaaaacatttaaaaagtttctggcacgtagcaagtactctgtaagtgttagctatagtttagaagtgcatgttgaatagttgcgaattatttgccctagattactttattattgctagttaatttttaggaatatcatgttaaataaactttgatatatttttataagtggttaccaacttatgttttataaaattatacttctctactactcaagtgaataaatttatttccatatcaattttatcatctttcctttccttcaaatttaatgaagaaaatgtggtgtactgacatactaatctgttttttttttttttttttttttttttagacaggatttcactgtcactgcagtgcagtggcgggatcacagttactgtagccttgacctcctgggttcaggtgatcctcccacctcagcctccctattagctgagactacaggcaaacagcaccacacccaactaactttttgtattttttgtagagatgggtttcaccatgttgcccaggctggtctcaagctcctgggctcacgtgatcctcccacttcggtctcccaaagtgctgggattacaggtgtgagccaccatgcctggccttgtttttaaaaaataaatatagaacttttatctcacttttagctttttatccattttatcccctcccacccccaccccttcaaatttcattgctttttaattttatacagtctgtcactgccagaaggctgcagaaccttcaacaagttctttcaggagaccacagtaagaaaagagtacatttatcttttattaaaaaaaatactaggccgagtgtggtggctcacacctgtaattctcagcactttgggaggctgaggtgggcagatcacgaggttaagagattgagaccatcctggccaacatgctgaaaccccacctctactaaaaatacaaaaattagctgggcatggtggtgtgcgcctgtagtcccagcttctcaggaggctgaggcagaattgcttgaacccgggaggcggaggttgcagtgaaccgagatggtgccactgcactccagcccggtgacagagagagactctgtctcaaaaaacaaacaaacaaacaaacaaacaaaaaaacaagaaatgaaaaacaaaaactaaacaaaaaaatcaaaaacttactttgaacttcttatgcatacatctaagtagagaaagtaacgtattttgtggttatatttttatcaccatgttagatggtagcttaaaacaaaaacagaaacaaaacagtttctccactatctccaggatggtgtgaacctgaaattgtatagattgaatttgggtccttctagcaggcgctttctatctaggttagaaaaaaatgctgtgttttcatcacattacagggtaagaattctgagaaaatgcaagttagtgtgcatgaatactctaatagctcttttcaagttagatcttagtatcactttaaatcttttgtttgagtaactatattgtggaatctcaagagcatttgagatgcttgttttaattaggaaataaaactttgtcaacaactctgtgataggtatcccttcttggttattttagttcatctaggttatcattctcctctttcagggcctaaacatattgaaattctacaattagctttttggtagaattggatataactctagtgattataattcataactaatttggtagcagatggaaagctcattggcaaatgaatgtctcgtatttgcagaatgtactatatatcctgaagaggtttttaaaacaatctttaatttttttctaacttagaagtatatatatgtaatctaggttctttctgtgccaggaggtcaggctaaaatgaagccattctagctgcatgaatagaacagggaattttattaaatatctctatttcagaaatacttagtgcagaatcaaacttactctaattggaattgtttagagttagaaaatgttaaaaaattgagtaaaatatgtgaagaattctggttaatggcttctcactttttcccgctgtgaactttgtttcagagatgcctttcaaacctttttgttgcaattatatagcagttgcccaatattcatttaaaattggatgataaagtttctactactttttctatatcttactagattttacattagtgacaaaggcatgattttgaaattgtattttggtctttgatcagcaaatcatggctctttgtatagtctttgagagaggtgctcaaagtcttcaggtaaattaatatctaattaggagaaagagggttgccctctcctgctgaaggtctctggggaaggccagtgcatagtcatgccctagcagtccattcctaagcctcgtcacctggaacccaagtcccctctatgtgcgtgacattctggtctccttgacaaaaagactgcttcctctcattgatgactttgtggacatggagaatatctaataagcatatcttttctatgaccccttcacataattgaaaaggataactatgccatttctttgttcttttcctatatttgacacctttgaataatttcccactcgtgctggatcgtctccaaattgattgaaaagtgtgctaatcttaaactgagtgtttaacagggtaagaattctgagaaattcttagaccacatgccaaatatcatagaccacagaaggagagctcatcagtatttttatgtcttttaataaagcctggtatcattttggtctttcctgtttatgagacgactgtatgaatttctattcacttatatattttttcttctctagctaacttttagcacttctacttcctttaatttttccctaaaagcaagtgtattctacacttgttcctattgcatttcattttatttttataggcaatcttttcttttcatagtttctagtgcctttgcccaccaagttccacacaacactctaagttccagccacaagaaatgactcacattcctgcaaacctgttatgctttttcatgcctgaatacctaagcatcctccttcctcttctctacctgggtacttgtgcttgtcatttaaggcaaacttcaaaggtcactgtatttaggaagccttccccatattctcccccgtctaagcaccatccctttgtgctcccatagtacaccgtatggatcctctatcttaccccttgttagtttatgagtccatttctgtgacatctaaggacagtgataaagaccactttgtgggtagtgactatgacctactcctatctctgcttacaacttctagcacctcgtcacatagttgggtgtcaaaaatgtttgtgaggctgggcacagtggctcatgcctgtaatcttagtgttttgggaggctgaagagggaggatcatttgaggccaggagtttgagaccagcctgggcaacatcgtgagaccctctcttaaaaaagtttttttttaataagtatccaggtatgatggcatgcacctgtaatcctagcttttctagaggctgaggcaggatgatcagttaagcccaggagtttaaggctgcagtgagctatgatcacaccactgcactccagcttgcgtgacagagtgagaccctagctgtaaaaaacaatgacaatatttgtggaaagaaattaagaaaattttaaaatgtattactgttattcagagcattgttaattcacattagtctgatgtcatttacaaactacacatcctgatttgcttcattcagttcatgcctgaaacatgtaagaatgaataggccgggcgcggtggctcatgcctgtaatcccagcattttgggaggccgaggcgggcggatcacgaggtcaggagatcgagaccattctggctaaaatggcgaaaccccatctctactaaaaatacaaaatattagccgggcgtggtggtgggcgcctgtagtcccagctacttcggaggctgaggcaggagaatggcgtgaacccaggaggaggagcttgcagtgagccgagattgcgccactgcactccagcctgggcgacagaacgagactccgtctcaaaaaaaaaaaaaaaaaaaaaaaaaaaaaaaaaaaaaaagaatgaatatctggctgggcgccgtggctcatgcctgtaatcccagcactttgggaggctgaggcgggcgaatcatgaggtcagttgatcgagaccatcctggctaacaaggtgaaaccccgtctctactaaaaatacaaaatattagccgggcgtggtgggagggtgcctgtagtcccagctaatggggaggctgaagcagaagaatggcgtaaacccaggaggcggagcttgcagtgagctgagattgcaccactgcactccagcctgggcgacagagcgacactccgtctcaaaaacaaacaaaccaaccaacctaatatctaacatttactgaacaccatgtgccagatgctattttaagaccttaaagcatgaattcatctaagttttacaacaaccctatggggtaggtagtattattattatcattacagataaggacagacttgctggaagattaaaagacttgcccctacctggctgaggcagtgtttgccaggttactgttctgtcaagctcctctttcccctcccccgcccccactttttttgtgagacggcgtcttgctctgtagccaggctggagtgcagtggcgcaatcttggctcactgcagcctccacctcccaggttcaagcaattctcctgcctcagcctcctgagtagctgggattacaggcacacaccaccacgcccagatgattttttttttttttttttttttgtagctttagtagagatggggtttcaccatgttggccaggatggtctcgatctcttgaccgagtgattcgcccacctcggcctcccaaagtgctgggattccaggcctgagccaccatgcctggcctcccttcctttttttatactgtcctctttggaagcaagtcactaagtgcagctcactcttagggagaggggagttttgctttccctgtattctcttttacatcgcctgccttgaattttctcacagaccatgaccttggttgattttctccttatcatttagatattctaaatataggtctaaccaaatgcccttagtctatctcctttccccactcagtagaccatctcatccatgccagtggcttctctgtcttctcctccatgctagagtctctcaaaggcataaccttgactgaggctttcttctgaggcccaagagaaattatctctgcccagaggcctgcaagcatgtgacagttctaccttctgagaactgaacgtttccttttcttcccttctccatttctattaatagcttctttaattgctaagttgtttagtcatgaaacttcagagtggtatcaagtctttcttgcttgcacctaattcagtgcttatcatgtccctgaaatcctccttaggaaatatctcactgatctcttcctttttatccccatggttaaccccagagtcagggcctcaatgtctcttatctaggtagtttcagctggtaacttaccacatgcctcttttctcacagtatattctatgcccatggtcagatgattatacagtagagctgaaattatagtattctgattttaaaatcttcagtggctccttagtagtgaatctaatacagtcccctatatatattctccaggcaagtgctgtgtctcagttacttcttgttatcaatgctagcatttgcatagcatttgcatagagtaaatcattttgacaggttaccttgctttacattatattgaatatcctttaaaatgagaaatagtgcctagataattactgtgaacaatgcccttggtcctacacaacactatcaataatggaccccttttctttcccttcctctccccttcccttcttttcctcctctctgtcttccttcctcccttgtcttgcctcgcacatgctctactaccaccaccgttaccaaaggaggtacaagcattttactgaacactagtgggtagagacaaaaagtgttgaaatatggctcctttcagccaaggtggaaacatgttcttcactgtgatatgtaagtcaccaaccattctagcccttacctccaaatacttccatactctgcttattgttatcaaaatatgtcttacatacacaaagatgggaacaatcaacaatggggcctacttgaggggggaggtgggagggagggcatgggtcagaaggctacctatcagttactatgctcattatcttagtgacaagatcattcaaacaccaagcaatttacccatataacaaaccggcacatgtaccccctgaacctaatgcaaaagtaggaaaaaaatgtctatgtaaattctgtttttaagcaaattaatttatcttgaatgccctgcttttggagacaaccccattacacacccacccacccccacacacagatatctctcttgtctttgaagacatatagcattctgtttatattaatgcatggggctttctttacaaaagtatagtcctttgtgtacatgtcttttgtcctttgccagactggtggtttctcgaggcaagtgctgtgtctcagttacttcttgttatcaactctagtgtttgcatagaatggacactcagtaaatcattttgacaagttaccttgctttatgttgtattgaaaatccttgaaatgagaaacagtgcctagataattactgtgaacattgccctgggtcctatataacactatcaacaatggactgtattttatatccaactgagtacacatcaaataattatctggctgacatataagtattgtcagaaattattttcttttatcattaaaaaaagttaagtgataagaaccaaagagaaacacatagtctagggtgtctgtatgctttagtagtttttatttaacagatctttaagtccctttgttagccaagatattttaagcactttctaatatttaattgtgtaacataaccatggttttagatttagcatctaggcaatttttctcttttgtgtactttacagaattcatttcagatataattttcagtgttgaataataacattttaaatcaaccccaagataaaagttacagtacaacataaaaaatgaagccagtttttctgtgtttcccattggcgaattactgttttttctgccaccagacttcatctaatgatgtgacctttaccatgctaatagacagcaaacaaaaatctgccaaattgtgataaaatacaggttttaaatctaaaataaattaagctaaaaagacttgtaaaggtcaaatgcatggaaagaattaagttgaaacagtgatttgtgttaaacacacgttgtaccagttttttcccaaggttatttttgaactcttaatgtttaataactgtacaaggaaatgcaattttttaaaaaagtaacactatagtagtgttgacttatctttgtggggctcaaatgttagtttattcagcaactctttattgtgctcctaatatgtgccaggcaatgcaatacagcagtgaagacctcagtaatgatcttgatctcttgccacttatggtttaataggaggtacagataaaccttcaactaaatcatacaacagagctaggctgtgaaagaggaaatgcaggtggaagctgtacctatctaacccaggctgctaagctgagtcctgaagataagacggaggagtttgctaggcataacagagtgggaagtgtggtgcatacataaaaggtacagaggtacaaaggtacagaggagaaagaaatgtgcattccgaaatggaaggaagttcatcatggtggagatgagttgagagaatgaaggactataaatgagtggttcttaatcaaggcagactttggccccagggaacatttgtcaatttctggcaacacttttggtgtcacaagtggcagagggggctgctattagcttgtagtgggtagaggtcagggaagctgctaaacatccgccagtgcacaggacagcctccacaacaaagaccagctctcaaggtcagtaatgcttaagctaagaaactctgtaatattaaaagataaacctgtacacttggggttagattacaaagctactgaaggaatttgggatttattctaggaatttgggggcaccactgaaagattttaagcacatgttgtttgtcactctgagaaccactttattgttatggctgaacctcagtattttaaaatctatactaagtctcactcatgtgggctaaccattgtgcctactacaaatgacatctccctattttacaaaggtggaaagagcatcattgtgaaatgttcgctaaaagtttaaaaaagaagatgaattaattatttgatcctcaccagtcacaacataattatttcaaaaacgtgtatttatttaattgggctccttcctgtcacacagggttgagcgtggggggtctactctcatgaatctaaagcacttctggagattaatggaaaatacactgggccaaggcaaggttacaacctgaaataaataactaagcttgtacattcagagcaaagggtttcctaatttaaaaaaaaacttagttccagactcttttgaacatctgatgacactatggcctctttttatttttatttttatttttattttttttacagaaatatgcacttatactcccaagtatttaacttcagaggctcacagaccctagagagatacagtggcttctcacttgatactgatgttcctagaaatatctaatggccagatttataacaatagacatttgccaaaaaaaaaaaagtatagcataatttagaatcaatcagagaaagcttagcatttcttaatcaaggagcaactctttccaaaaatgctcatcaagataccatttacgtcaacttgtaaaatataaataatgttgcatcacagcaaaaaaagtctagggaaatgagcaatttttttatgacccataatgaagacaatgtgttgctctggttacaataacctctgtgagaaacaattctgtaaaccatgtgctttctgctgattcctttccatctaatcattactttctctaaaaatagtgattgattataggctccgtgtcttgcaaattggaagaaagggtgaactgatacgtgcttgagttcatcacagtttttttgttctacaatcaagtaccagactttggattccctttaccttctttgactgcagatgtcccaatggtcttagtcatgacgaaactgcccccaaacacccgcatcttatacagacacacatgcacacacacatacacacacatatgtgtgcacacacacacacaccctcttcagttctttgaagggcttaatgcatgcttatataaaggtttctatctattttgatgccatcaccattaactcaattctacttcttgatttgccagtgtgccctatcatttttctcacttgctagttctgttcagagaatctgtgtcagctttacctccaattctcactgtgatttctagtaatctgaaccacttgaacctgattccattatattgggattttgtgtactataaatattagtcataggccaggtgcagtggctcatgcctgtaatcccagcactttggaaggccaaggcaggaggattgcttgatcccaggagttcaagaccagctggggcaacatagggagaccatgtatctacaaaaaaaaaaatgtttaaaagttagctgggtgcagtgacacatgcctgtagttgcagctactgagggctgagaaggaaggattggttgagcccaggaagtcatggctgcagtgagctgtgattgtgccactctactccaacctgggcaacagagtaagaccctgcctcaaaaaataaaataaagtaaaataaaataaaataaaataagtcaaaatcgaggtatcagtgggggctgcagttctcccctggcactcagggtcctcttaggagcttcttgcttacttgcagaactcatttccctctcatgctttttatgtgactggctccaccttcagacccgcaatggcagggagagctctcatgcttcccgtctctctgacttcatgttctgccacatatccctgacaccagcttgagaaagttctctgcttttaagggcttatatgattaaattcggccaacctgcataacccaagatattccttccatcttaggtctgtagccatttaccatgcagcataatatgctcataggcctcaaggattaagatgtggacatctttcaggagcattcttcctaccagagaaacctacaggtaaaatggcatggacattcagagagagagagagagagagagagagagaaagagaagggtcagttttaattaggaatgtgaaagagctagtcaattagaactatgagaggtagaacaattttagctgggcttcgagttacagatcaaattttggttggtggagatgaagttgggggatgcatttcagatgaaggtgtttagagaaatgatgagaagtcaaacttggggtaggaaggaggacaaagtaggttggagtcaaggagtagaagaccttaaattatgggtcaatagtttactcgtactaaacatataaactataccttaagtaaaaataagtcttaaaattaaatattaaacagaaacatccttaattgctaccagtgaattctgagaaaagtcagtttgcaatagttggatacatttagcagcaggaaggataatgttactggtatgatgtgggttgtgggaaaggtctgagaattgatgaatccaactaccgaagtggttccttttaccaactcctatgtaaggacttctgattaagatttgatattttctatgaggtgatgcctcagattttacactattgtaaaagcctgtttccaccataaatgcggaaatgtgttgcaggttatctatttcttctttcattcctgaaaacctgaaaataatcaattgtattatgacttgaaagtctagagatgaaaaaaaaatacaaaagatataatagaaggaaaattcctgtttacagtagcagccgaaaagataaaaggaaatgaacttatgaaacatgcaagatttagatgaagaacacttcaaaatgctgtcaacagactaaaaaaagaatcaaattaatggaaatatgtactattatgttcttagatcaagaagactaaatagaaagacatcaattttcctatgttaattcaaaatttaatatgttattatgtcaataaaatattgttttctttcatttttactggaaaaactacataaaaatttgtatgaaaaaataaatgagaatattcaaaaataaaaattctaaaaaaggaaagctgatagatgggactagccccatcagatagcaaattacacctaagtgtttcaatagcttaaacactatagtagcagttcaagactagacagggaatccaatggaacaggacagtgcagaaatagaccaaaacacatgccatattataaagaagccatcttaggtcaatggaaaaaaatatgaattagtcactaaatggtactgggacaactggctagctatctagaaaaaaaactgtatctatagaatacagaattccaatctacagaataaactccaagtggatcaaaaatatcaatgtaaaaagtgaaatcataaaaacattagaagaataaataagaatattcctttatgatcttagaagctcagaagccataaaaccaaaggtatatataatgattttaacaattttttcatggctaaaagcaacataagctaagtcaaaatatggagttgtttagaggaaatgatgagaagtcaaacttggggtaggaaggagcacaaaataggttggaatcaaggagtagaagaccttaaattatgggtcaacagttcactcgtactaaacatataaactataccaaactataaactacaccaaagcaatatttgaaatagcaaaaaaaaaaaaaaaaaaaaaaaaaaaaagaaacactttaaatgtcatttgtagggaccagttagttgataaaccatgtttgattcatataatggaatgctatgctgctatcaaaaaaaaaatgagagtttcgtatgtattgacataggaagaactcctagatatgttatggagtgaaaacagcaaagtgtaaaatattgtcttagtatgccaccttgtgtataaaaaggaggacattaagaatacatatttatagttgcttgtatatgtcacgtgcgtctgtgtgaagagaccatcaaacaggctttctgtgagcaataaagctttctaatcacctgggtgcaggcgggctgagtctgaaaagagagtcagcaaagggagatagggttggggccattttataggatttgggtgggtaatggaaaattacagtcaaagaaggtttttctctttcaggcaggggcgagggtcacaaggtgatcagtgggggagcttctgagccagaagaaggaatttcacaagaataatcgctcagttaagttggggcaaaaataaatcacaatggtggaatgtcatgagataaggcaggaactggcaattttcacttcttttatgattcttcacttgcttcaggccatctggatgtatatgtgcaggtcacaggggatacgatggctgagcttgggctcagaggcctgacattcctgtcttcttatattaataagaaaaataacataaaatagtattgaagtgttggggcagtgaaaatttttggggggtggtatagagagagaaagggtgatgtttctcagggttgcttcaagcgggattaggggcgacatgggaacctagagtgggagagattaagctgaaggaagattttgtggtaaggggtgatattgtggggttattagaaggagcatttgtcatttagaatgattggtgatggcctggatacagttttggatgaattgagagactaaatgaaagacacaaggtctgaataagagaaggagaaaaacaggtattaaaggactaagaattgagaggacccaggacacccaattagagagtgcccaagggggttcagtgtaattacttgcttggttggcaagtttttgggctctatccttgagttttttttatgttgtcatataccaggccagactgatttaggtaaaacaacacttttcatttaaaaatctacagagtcccctttttttagcagtgagtaagttgaggctttggcgattttggaggaaagagaaatgcaaagccagcaattgttttttaaagaaggattagaaacagctaggagacagtgagtgagattgatagtgtggtggagacagctggggagaggtagagggtggcataagaatgggaatgagaataagagtgagtataaaagtaaagaataggacttcattggatgaaagtattggagtgtaccctgtcagcaaagatcatctatccactttaagagtggcagtttaggaatagcaccaggcgatattagctgtgatggcttggagaaacagtgtaaacaggcagtgtaaacaagagcaggacatttatgagtagttgagaacagtgaataggagtatgactagacagaagacagtagggatgacaagtttttggggtgcagtccaagttgggctggtgtctggaatgagactggggcctaaaaaagaggagtgtccatacaggagctcaaatgcgctgtaccctcgtagcatcctgagggcagacccaagttctgagaagggcaagtggtaaaagtattgtccagtcctttctaagttggaaactgaacttggtgaggtgtgtttttaaaagaccattagtccattttacctttcctgaagactgaggaccgtaaggggtctgaaggttccactgaataccaagagcctgaaaaactgcttgggtgatttgactagtaaaggcctgtccgttattggactgtatagaggtgggaaggccaaactgaggaattatttctgacagaagggaagaaatgaccgtggtggccttctcagaccctgtgggaaaggcctctacccatccagtgaaagtttctacccagaccaagaggcattttagtttcctgactcagggcatgtgagtaaaattaatttgccagtcctaggcaggggcaaatccctgagcttgatgtatagggaagggagggggcctgaacaatccccgaggaggagtagaatagcagatggaacactgagaagtgatttccttgaggatagatttccacgatggaaaggaaatgagaggttctaagagatgggctagtggcttgtaacctacatggaagaggctatgaaatgacaacagaatagaatgggcctgtgaggctggaaggagatattttccttggtctaagaactatttgccttgtatgggaagagattgataggtggaagtttcagtgggggagtaggtgggagtgactgatgagaaggagaaaaactggtcgtgagggacagaagttggaaagctagctgcttctttagctaccttatcagcataagtattgccctgagcaatgggatctgatgccttttgatggctcttccagtgaatgactccaacttcctttggaagtaaagcagccttgagaagagtttttattaaagaggcattgatgatggaggacccttgcatagtgaggaaacctctttctgcctatataacagcatggtggtgcaggatatggaaggcatatttagggtcagtataaatattgatgtgtagtccttttgcaagagtgagggctcaagttaaggcaatgagttcggcttgttgagaggtagtggaggggtcagaaagtatatgtgtcagatgtgaggaagaaaatagattttggaagttatgagaactgtagagagtgagttgagcatagtttgtgattttgagggcctctaaaagtattagggcagtggcagccaccgcgcggagacatgatggccagcctaaaacagtaaggtcaaattgtttgaacaaaaaggctacagggtgtggtccggctcttgtgtaagaattttgaccacacagccctgcacttcagctgtgtgtaatgaaaaagggttggaatgagttagggagagctagtgtgggagtagtctctaaagctgtcttcaaggaacagaaagaggagtggggaaaggatttaggatctacggggtcagctaggtttccttttgtgggtttttataacgtttttgttaggatggcaaaaccaggtatctaaaggcaaaagcacccaaccatgcccaggaaggaaaggagttgttgttttgtagaaggggttggggtttcagagatcagtcggacatgattggcaggaagagcacgtgtgtttttgtgaagaattatgccgagataggtaatggattaggcttgactgaagtaatgggggctgtctgcgaagccttgtggcagtacagcccaggtaagttgctgaggctgatgggtatcagggtcagtccaagtgaaatcaaagagaggctgggatgaagggtgcaaaggaatagtaaagaaagcatgtttgagatccagaacagaataattggttgtggagggaggtattgaggataggagaatatatgggtttggcactacggggtggataagcaaaataatttggttgataaggtgcagatcctgaactaacttgcaagacttgtacagtttttggacagctaaaatggggaattgtaaggagagtttataggctttaaaaggccatgctgtaacaggtgagtgataacaggctttaatccttttaaagtgtgctgtgggatgggatattggcattgaacggggtaagggtgattaggttttaaagggatggtaaggggtacatgatcggttgccaaggagggagtagaggtgtcccatacctgtgtattaaggtagggagatacaaggggagaatgcgaaggaggctttgaactggggaaaagggcagcaatgaggtgtgactgtagcctaggaatagtcagggaagcagataatttagttaaaatgtctcaacctaataagggaactgggcaggtggggataatttaaaaagagtgcataaaagaatgttgtccaagttggcaccacagttggggagttttaagaggtttaaaagcctggctgtcaatactcacaacagttatggaggcaagggaaacaggcccttgaaaagaaggtaatgtggagtgggtagcctctgtattgattacgaaggggacggacttaccttccactgtaagagttactgaaagtgtctgtgatggtccaggaggcttccgaggtgatggggcagcatcagccttcagccactaagccgagaagatctgggaaggagtcagtcagagagccttgggccagagttccaggagctctggtagtggctgcagggtgagttggacagtccgatttccagtggggtcctgcacagatgggacatggcttaggaagaatcccaggctgtgggcattccttggcccaatggccagatttccagcactgaagtaagatcctgggggaggaggtcctgaaggaatgcttgaccactgtggtttaggcattttgaagttcttgtgtgctggagatgtggctggggtttttctcacagtggaggcaaggaattgcaactcagaaatatgttgctacttggctgcctctactctattattgtacaccttgaaagagaggttaattaaatcctgttgtggggtttgagggccagaatctaatttttggagctttatttaatgtcgggagtggattgggtaataaaatgcgtattgaaaataaaacagccttctgacccttcagggtctagggttgtaaagcatctcagggttgctgccaaatgagccatgaactgggctgggtttttatatttaatgaaaaagagcctaaacgctaactgatttgggagaggttggataaagaaaaagaagcattaaccttgactatgcctttagctccagccacctctttaagaggaaattgttgggcaggttgggaagggctagttgcagaatgaaactgtaagccagaccaggtgtgagaagtggaggtgatagaaggattatagggtgggggagcggaggcagaggaagaattggagcctgattcagcctggcagggagtcacctgaggaggagcagtctggggaggaggggagaagtcagatgggtcggtagaaaaggaagattgaaaagactcagcgatgcttggggttgggactgaggggacaggcgggagggaaagaaggaggttttgggatcattcgcattgggaacagagactagggagggactgatgtgtaaaagaatgcctggacgtcaggcacctcagaccatttgcccattttacgacaagaattatctagatcttgtaggatggaaaaatcgaaagtgccattttctggctatttggaaccattgtggagtttgtattggggttaagcggcattgcagaagaaaataagtcatttaggttttaggtcagatgtgagttgaggaggttttaagttcttgagaacacaggctaagggagaagaaggaggaatggagggtggaaggttgcctatagtgaaggaggcaagcccagagaaaagagagggtagagatgtggagagaaggggtggggggttcttgccccccatgaaagtggtgcttgccactaagggtgaaggatcaagggaggtgtccccgcggtgatcagacacctctgaaacgtgggtgaataatcaagcatgcgtccccgcagtgattaatgaccaagggaagactgtcttcccgagtctgtgaccggtgccacttttgggttcacggataaaacgcatctcctctgtctctaccagagaaggaaaagaactgaaattaagagaacggagagattgaaggatggcaccaagattgaaaggagaaagagattgagggatagtgagagaggttggagaagagagtaaaaagaggctgcttacctgatttaaaattggtgagatgttacttgggctggttggtctgagaacgagagattgtaggtggatctttctcatggagcaaagaccaggaggacaggggattgatctcccaagggaggtcccctgatccgagtcatagcaccaaatgtcatgcacgtccgtgtgaagagactatcaaacaggctttgtgtgagcaataaagctttttaatcacctgggtgcaggcaggctgagtccgaaaagagagtcagcaaagggagataggggtggggccattttataggatttgggtcggtagtggaaaattacagtcaaagggggtttttctcttgcaggcaggggcgggggtcacaaggtgctcagtgggggagcttctgggccaggagaaggaatttcacaagattaatcgctcagttaaggtggcgcagaaacaaatcacaatggtggaatgtcatcagttaaggcaggaaccggccattttcacttcttttgtgattcttcacttgcttcaggccttctgggtatatatgtgcaggtcacaggggatacgatggcttagcttgggctcagaggcctgacagtatacagatgcagaaactttggaagtgtacataagaaaccagtaatagtgcttatttgttcagaggctgggaaagtgagtacagatggtcacaggtgagaataagatttttctctgaatccctttttatattattttattttgtactactgattcaaaaacttacccccaaaataagatctggcaaataccttgccttttctaggcagctctaattcattccatcaattcttgttttattaagtcatcatagggactatgtgccaagcacagaattcttttctggcatcagaattgtacaatattgacttaaaagtaattgacctagaatacagtaccacatggtgccaaaatacaaaagggtctgtgtaatactcagttcgagaaaggtaaggtccttttgggttttgggcctctctggctctcatagccacttcagaacagtgagttataaccttgtaactttctgaatccatctaccaggctataaaactccagggatctggtgagccaggctacttggggccaggaattgggcgagtcaatccatgactaggatacagagttagcaaataagggattggccaggattcccactctgaatttctttctctcttcccctggcctcaatgatctaccctgaccacttacctctatagacccctatgagtgctgacattgtgtaagggtcaaaagagagaaatagggaggaagtcagactgagagggagaaaattggcatttgcaggttctacatacatgagtggtatttttaattaatgagatttttggagacactttcattaaaaccatttttatatttttaggcttaaattttttgaaaagttaaattctaggcaaagaggcccagatcctttcaaatagggcaagttgtggctgaagaccaattacctgcatgcagagggcagaagacggaagggagcaggcaagcttggaataaatgagattccattccaattaaatgaggagtctcagaagcacctcccacaagctagaattactgtgatgcctgttgatgttttaatctcttcttttctgtcgggtgagaggcatataaagaatcagagaaataaggaaggccagtcacttgagaaaccacataagctttttttttttctttataatttttaagcataaagaggctgactgaaattgagatgcgattactatacaaatggcctgagaagaacaaaggcaacggtggttttgacaactgaccatggtggataagattttaattatttaaagaaatcctagaaaatcttaaaaaagaatcagatggaaagagaatcactcaagctttgaaaggaaacctaaggttaaaattaacaaggcacattaagagctgaagatgagttagaataatacccgattttacctggtatttaccctaggttttcctctaaaattgagcatcttgtttaaagagagtatttcttcatatttctagatttttttgtttaatagagaattctaccttggaggaagcctgagtagaaaattttgttaaatttggtgactgacttaatcatgcctttgggaagactagctattcagaccttgcagctataacttagacatccttctgaaaaggatgacagcatctgcccccaaaataaagaattcaaatagtgggcagagtatcgggagaaacttagaggccactgaagtgttagcataaacatgcaaatctgcaaaataaccttggtattttgccaagattattttgcagatttgcatgtttgcaagcaacagatatataccattttgtatctgttgctcagaggacagcactaaaattggctctttaggcagatgcagctttcaaaacaagaattagattttaggtcttcagagtctcaaaaacaagaaaggcaaacaaaacttagagatgattgttgaaatatatttaatattttacttttgcaacttgaaagctagtgacttttttttttttctttgagatggagtctccctctgtcgcccaggctggggtgcagtggcacaatctcagctcactgcaacctccacctcctgggttcagatgattttcctgccttaacctcttgagtagccggggttacaggtgtgcaccaccatgcctgactaattcttgtatttttagtagagatggggttataccatgtgggctaggctggtctcaaactcctgacctcaggtgatccacctgtcttggcctcccaaagtgctgggattacatgcgtgaaccaccgtgcttggccaaaagctagtgatttttatctttgcattattttaataaagtaattttcaaaagttttaaatgacattggagctcagtttgcaagtttatcttctatagaatcttacatacataaaccaaaaactagaaatttattagttttaacctgtaaattcacatttattacagtttttacttaaaaatagactgttgacaagctgataatttgaaaacagaagctgtcattataatagtagttatgacagttgtagtcctttgtcagcttcaagactcatctgatttttgtatgttattttgtttgcacaatagggagaaaaatcttaattcactaaataggagcaaatagctttctaacacactcattttgcattctttgggtactggattacttaactgattttgaaacaccacaaagaatggtagattgttttcctacatttattcattaatacttctaactactgttcacataattaagtgttcaaatttcagagaagttgataaaaagatataatcaattcttttggtagaaaatgcttttaaactgtatcttataatgtgatggtaagtggtgttttaaaaaaatcttgtatacttcaatgtttgtctataaaatatagagtcacttaaaatttcaagtagtaaaatggattttgcttttcatattaagtccaaaattttgtttcattactaaggatggtataactacaacctgaacagccttacaaatgttatttatgttgtaaaaattactgtcaagacaaagaagctgatgtaaaatgtataatcaaatgtgacagatatcacactcatgaataattaataaaaagccacgtatgaaaagctacatgtatttcaaaaaattaatattgcatttataagaagttcaattgtatggaaagagatgtccaagcaaatattattttgaaatttgtgcctgacagcgaaagatcaggcattaatgctctccaatgtgttaacatttggtatttagcacttttgaacaagttggtttgtgtgtttgtgtgttacagtataaatcacatcaaaaaaagtataaagtcatgtttgaattaaacaacattgtgtgactcctgaagcacattttgaaatagcttttaagatatctcaatagtagagtcagagttttgggacttaggattggaaacaattactacaagcctaaaatcctgagctttcatgttggtgtataaatcccataaatctcttaatcactcctagggcaagctttcatctaattttcccaagagagagttatcagacaaattcttggagttcaattagggcatgttggagctcttcagaggataggtttcatataattctaataaatcaatatgaatcccaagcttgtataatataattgtgttaaattcacttcttcagaatgctgtgctatgacattatgtctttaaattgttatcacaaaaggctgaatttcttttctaaaaaaaagtaaagttaaaccttctataagtaaataatagggcattttctaaagctgtctcacagtgtatttttctggtttggtctttagttaattttaccactggtctgtatcaactaaaggtattttatttaagatgtcacgaatagtaataattactgaaaaagatatagcaccttaacttaggaggctggtaatctgtcagaagcgtaaaaatcattaacacatgtatcctttacataactgaattcacttaaaaggcaaactaccagggtctataattatagcctgattacaactttcacttcctgtgtcaatttcatgaaatgaaatccattcagcgcaccagcatggcacatgtatacatatgtaactaacctgcacaatgtgcacatgtaccctaaaacttaaagtataataaaaaaaataaaaaaataaagtcagctcataataaaaaaaaattgtcttcatatctcagtttgttcttcttcctgttactgtactttagaagagtaataaactctatttagcaactcctttccaaaagtaggcaatgtaaaataagtcagcttcttctaaagcattcatgtaaatgattttagccttcctcagtcttgacctttacttacatttccctcattatgataatttttcaagcaatctgtgaaagataatatcacaactctcacttcccctaattataggcttgttgtgagagctgtatttgcactctcccaccttcttcctgttttgtccttatgttaatctgtgaaagaactaatgggcataaatcctttaaaaattatttaattctggtaaaaatacttcacatgagatctaccctcttagcaaatatttaagtgtacaattatagttgacgataggtacgatgttgtatttgcatttttttgtctctgtattctattgaccaagctaggctcctgaagtggtgtagcactatctggcatggtggatagtgacatgagaagccaaaaatgacttcagaaagagggtaattcagaggactcattagcttaggtgcgagggagacacactactgcattggagttgcatacaactaaagggtttgctggacagccagatttagtcaggcaagttctgccttcttgttcagatatgttttagctggatagaaaacacttaagaaatatctattaagtaaatccattcacataaccagatatgggaaaaagctgtgttagcatgttcctggtattgtagaaaccccatttttcaccaatgtacaaatagaaggctctgctaaataactaattattacttactgctatcctaataaaggataagaagaatgcccatttatccaagtgggaaaaattgaaataattatttattcttgtttttggagtgtacttatacatatatacttgagtgtgactttcattctggaaactcacattgcttaaaaaaaattaagccacattaaactgaagttaaatagtagtcaaactacgattatctgactcaagtgacaacacatttatctttttcccattctttctttgctgatcagttcttcagttccaatatagctccccgttgactgcagcaaagcaacagccttgatagagttgatttttttcttccatttactatttcccatcttacttatcacataggaaaaaagaagtgctttgccatatattgcaacttccagaaaaacaaaatcttctttatttacattagaaagccctgaaataagtggagcaggtgaaattgtcacaaaatttgaaggcatgagttagcatggttaatcagacattctattcaaaggtaaggcacataggctgtctcatctttgacaggaagtatagaggactaatgattttatccattctttctccctcattttgcttcatgcaatatacaaaaaatgattcaggtgggtgaaagacttacatgtgaaaagcaaagcttctacgcaattttttaaaaggagttaggggaatatttttgtgtcatttgctaagatttggttgtttgacccctccaaatctcatattaaaatgtgattcctaataaggtgtttgagtcatgggagtggatccctcatgaatggcctggtgttatccttgagataatgtgtgaattcttgttctattagttcccataagaacaaaaaagagcctggtgaaaaaataaaataaaaataaagataaaaaagagcctggaacatccctgccaccccgttgcttcctctctttccatgtgtctctgcacatgccaactccccttcaccttccattatgagcggaagcagcctgaagccctcaccagaagcagatgctgatgccatgcttcttgtacaggctgtgaaactgtgagcgaaataagctctttttcttaacaacttacccagttttaggtattcctttatagcaatacaaacatggatttagatagcactggagcaaaaatgaacagatcacaagagaaatgattggtaaatctgacacatgaaaattaaaaacttgtatgtaaaaaaagacactgtaaactaagttaaaaaatgacgacaaaagggaaaaagatatttcaagacttataagaaaaagcattcctatctagaaactgtaaactcctacaagtcaataagaagacaacgcaattaaaaaatgggcaaataatatgaacaggtaattcacagatgagaaaactcaaataaacatattaaaagatgtccaacctcactaggaatgtggggaattcaaactaaaacaacaatgaccacattttatacttcaaaatttacaagtctattaataccaggttttagcttgtagagaaagagggaattttcataaacttctggcagaagtataaattggtaaaaccacttgggaaagcaatttggtaacacttggtaaagaaaataaacctatccacattcaggtatattccttgacttttgcacatatgcataaggagacattataaaggtattcattacagcaatggaaacaactagatgaatggccacataaatgacaaaatcctatatggtatctaaaatgaataaatatacccaatacatatcaaaatatgatgttcagtgaagagcaagtttcacaatgtttattattcaacttgtataaaaatattaagatatagtttatgcagaaaaatatacaaatatggacaggaaagatataagccatcatcagaatagaggtcatctttggagagagaaacatggaggggattggaataggggaaagaaaagaggacattcactcttctctgtaatattttatttcataaaaacaattgctgaagcaagcatggcaaaattaacatctatcatttggagtaatgaggacataaatatatattatattatcttctgtattttttctgcttattttaatcatttcataactaagcaataaaataatagctgtacactttaaagataaattaacgatagatgctcaaaactaaaaatttgaactacttaaaatattttattttccaaaataacaattgataaaaatttttttaaaattaaaaaactgatttaaaaaataaaaaagctaaacattacatagcaggacttatagaatatggccaatatgttctttagacaaaaattgattgtctttaatgcacttacttcaagagttaattcagaataattcctataaaacctgaggcaagtagctgaaggaaataacaaagatgattgtagaaatcaatactttcaaaactgggtctttagaaaaacaaagaaaatagaaaaatttctagaacattaaagagaacaaacaataaaacctaataagtgatattagaaataaaaaaggcatacctacagaaagaaatagagaagtaaaaatgaaaagagactaatacacacactggtatgtgaacacatttgaaaacaaaaaaagaaataaatcttcttaaaaatatacatataaaacttaagaagaaataggaaacccaaataaaaggcaaacaagggaaaaattaaggatggtatcaaaggctcttgcatcgaatagtattatgagtgaattatttaagacgaaatacatatatatacccacacatatatatatacacatatatacacacacacatatatatatacacacatatatatatatacatatatatatatgattccccaccacagaaaaatatggaaagctacccaggtcattttccaaagctagcaaaccttgaaatctacatgtgtcaaagatggcattaaaatgtttctatagctttttctcacttataggtatagggtgcactaaaaaagaataattagcaatagaattagccaatatattaaaataattcatcctatgataacagtatgttaacttatcagtagagccaataagaaaaacacagatgcagccttaacaggtccttaatcagagttgggataaattttttttaattattatttttttaaccttattttttttaaattttactttgagttctaggatacatgtgcagaacatgcaggtttgttacataggtatacatgtgccatggtggtttcctgtagccatcaacccatcatctaggttttaagctccacatgtattaggtatttctcccactgctctccctccccttgccctccactccccaacaggccccagggtgtgatggtcccccaccgtgtccatgtgttctcattgcccaactcccgcttatgagtgaggacatgaggtgtttggtcttctgttcctgtgttagtttgctgaggatgatggtttccagcttcatccatatccctgcaaaggacatgaactcattctttttatggctgcatagtattccatggcatatatgtgccacattttctttatccagtctatcattgatgggcatctgggttggttctaagactttgctattgtaaatagtgctgcaataaacatacgtgtgcatgtgtctttatagtagaatgatttataatcctttgggtgtatacgcagtaatgggattgctgggtcaaatggtatttctggttctagatttttgaggaatcgccacactgtcttccacaatggttgaactaatttgcactcccaataacagtgtaaaaacattcctatttctctacagccttgccagcatcttttgtttcctgactttttaatagtcgccattctaaccggcatgagatggtatctcatggtggttttgatttgcatttctctaatgaccagtgacgatgagctttttttccatgtttgttggccagatagatgtcgtattttgagaagtatctgttcatatcctttgcccactttttgatggagttgtttgtttgtttttcgtgtaaacttgtttaagctccttgtagattctggatatttgaccttcgtcagatggatagattgcaaaaattttctcccattctgtaggtttcttgttcactctgatggtagtttcttttgctgagcagaagctctttagtttaattagaacccatttgtcaattttggctttgttgtaattgcttttggtgttttagccatgaagactttgcatatgcctatgtcctgaatggtattgcctaggtttcctggaagggtttttatggttttaggttttacgtttaactctttaatccatcttgagttaatttttgtataaggtgtaaggaagggatccagtttcagttttcggcatatggctagccagttttcccaacaccatttattaaatagggaatcctttccccattgcttatttttgtcaggtttgtcaaagatcagatggttgtagatgcttggtgttatttctgagggctctgttctgttccattggtctatatatctggttttggtaccagtatcatgctgttttggctactgtagccttgtaatatagcttgaagtcaggtagcatgaagctttgttatttttgcttagaattgtcttggatatatgggctttttttttggttccatatgaaatttaaagtagttttttctaattctgtgaagaaagtcaaaggtagcttgatgggaatagcattgaatctgtaaattactttgggcagtatggccattttcatgattcttcctatccatgtttttccatttgttcgtgtcctctcttattccttgagtagtggtttgtagttctccttgaagaggtccttcatgcgccttgtaagttgtattcctaggaatacagcgttgcttttattgttaatgggatggatagatggatagtgtgtgagatttgtctttttctttttaaattatattttctgattgatacattgaaaagctactagggtgtgtgtgtttaattcgaacagacttttaattgactctatggggtttttaaaataaaattttcctgggctcaagtgatcctcttacttcagcctccccagtagctgggactacagttgcgtaccccagtccagctatttttcgtgtgtgtttcatgatggggttttgccatattaccaagacttgtctcaaactccagggctcaagtaatcctcccaccttggcctcccaaaatgtcagaattataggtgtgagccaatgagcctggcccaatattatttctgatagcttggccagtccattggaaggaaccatttgtttcaacttctcaaagcattagtgccttggtggacatagcttccagaccttgcattggaatactagcaaagtctaagagggattcagtctttaatttcataatataacagcctgataattctgtatataggagccatgtagatgagatacttttttagaacctatacttactcagtgtattatgtttctgttacaatagcttttttgagaaataattcctgtatcatacaaaattcactatttaaagtgtgtaattcaggagtttttaatatattcatggagtcgtacaagcactatctaattccagaacattttcatcactcctaaaaaacccatacccattagcagtaattcccctctttccttcccccagcccctagtaaccactaatccagtctctgtctctactgatttgtctattctgggcattttatataaatggaatcatacagtatttgtccttttgtgactagctttttttcacttagcataatgttttcaaggttcatccatgtggtagcatgtatcattacttcattattttctattgtcaaataagattctattgcatgaatatataatattttgtttgcacatattatattttgcttattcatttatcagatggaggtcacttcaattatttccacttttatggccatatgctgccatgaatatttatgtataaatttttatgtagacatatgttttcacttatcttgggcataaaccaaatagttaatttacaagttctagtgtaattttatgtttaacatttttgggagctccaaaactgtttttttaaagtgactgtgtaagttgggcatggtggctcatgcctgtaatcccagtgcttcagaaggatcacttcaggccaggagtttgatacctgcctaggcaacatagctagagccttctctacaatacatagatacatacaaagtgactgtgccattttataattcatctagcaatgtatgagggtgacagtttctccacattcttgtcaacatttgttatagctcttctttttaaattttagacattttagtgggtctgagagaaataatacactgtattatttttattcttttgaaattgttaaggtatgttttatggcagagaatgtggtctaccttagtgaatgttccatatgagcttgagaagaatgcacattctgttgttgaagtaatgtagagatgtcaattatattcagttaattgatgatgtttttgagttcaactatgatgtttttgagtgcatgcgtccttactgattttctgtctgcaagatctgttcatttctgaaagaggggtgttgaagttacccaactataatagtggattcttctacttctttctgcagagctatcggttttatctcatattttcatgctctgttgttaggcatgtgcacattatggatagttatgtctttttggagaactgatccatatcactatgtaatgcccctcattctccttgataacttttcttgcattgaaattttctctgtctgaaattagtttagcttgattaacattagcatggcatatctttctgtatcactttacttttaatccatatgtgtatatttcaagtgagtttctggtagacaacatatagttgggtcttgttttttgatccacactgactgtcttaaccggtatatttgtaccattaatgtttgaaatgattattaatatctatcacattttttttactattttctattcattgctcttgtcctttatttctatttttgtcttccaacctttgtttctatttttgtcttccaatctttttcttccttttgtggttttaattgatgattttatttgattctacttttttgttagcatatcaattatattttttaaaagtcttttagttaccctagagttgtaatatgcatttatgattaattcaagtccacattcagataactccatgctacttcatgggtggtgcaagtactttataataaaaaggattcctaatttctccttcccaccccatgcattattgctgtcattcatttcacttgtacataaactataataattgaatatattgttgctatcattattttggccaaagttttaattgttaggtaattaagagtaagagaaacaaggccaggctgtgtggctcatgcttgtaatctcagcactttgggaggctgaggcaggaggattgcttgaggccagaagtttgagaccagtcttagcaatataatgagacctactctctactaaaaaataaaaacattagctgggtgtggaggcatgtgtctgtagtcccagctacttgggaggctgtggcaggaggattgcttgagcccaagagttcaaggttgcagtgagctatgatcatataactccagcctgggcaatggagtgagaccctgtctcaaaaacaacaacaaaaaaggaaaccaaaagtttttgtttcatgttcacttatttcatctctaatgctcttcttttctttatgtagatctgagtttctgacttccatcattttccttctccctgaagaacttctgttaacatttcttgcaagacagatctactggcaacaaattccctacattttttgttaatctgagaaagtgtaatttctctttcactgttaaaggataattttgcaggatacagagttctaggtttgtaggtttttttcctctcaaaaatttaaatatttcacttcactctcttcttatttgcatggcttctaaaaagaaattgtatgtaatttgtatctttgctcctttttaaggagtttttttttcttctggattattttaatttttttatttttgactttctgcaacttgaatatgatacgcctagttacagttttttcttgtttctttttctttctttttttttttgcattcattctgtttggtgttctctgagtttcctagatctgtgtggcatctgacattaatttgggaaactctccgtcattattgcttcaaatatttatttcttggtttctttctgcttcttttcttcttctgttattcctattatgtgtatgttactcattccgttaagtgtcctctagttcttggatattcagctacattttttaactgtttttctctttgcttttcagaaatttttattgacatatcttcaagctcagagattctttcctcagccatgtccagtctactactgagcaaccaaactagcatttctttctgattctttctttccatctctctagttaaattacccttcttttcttgcatgctgcctatttattccatgagagctcttagcatattaatcatagttgttttaaattcatggtctgataatcagaacatctgtgccatatctgagtctggttccaatgcttgcgctgtctcttcaaactgtgtttttgtctttttgtatgccttgtgattattttgaaataatatactgaatataatgtactggataaaaggaactgcaataaataggtatttagtaatgtgggtggtaaggcatggagagagagaagtgttctgttgtctcatgattaggtcccaggcttttagttagcctgtgccccttggatgtgaatttcacaggtgcttctatgctttttctccactttggtgggacaggatggttaaagttggatatttccctttcctaaggtcagttaatctctggcaaacctcattaaattagactctggtaaaatagtttttcttgagggcagaccttacttagaagaacagaaggctctggcttatttcaaaatggttgctttccccctccctcatgctaatcttcactatgagaatttggtacagctcctgaaggtaaaactcacaaaagtgtgggactccataagactgtgaagtcctgaagttattaactctcagacttgtccatactgagcccccagcaatttgacaataatagttcaggttttcctaccctggcactggtttccatggaagtttctggttgtgggtttctgccccagtaagttgtgattctctgtatacacctcggtccatttgtgtcacaataaaggaatacctgaggttaggtaaaatttaaaaagaggtttatttgactcatggttctgcaggctgtacatgaaacatggggccagcatctacttctggtaatagacttaggctgcttttcttcatggcagaaggtgaaagggagctggcatgtgcagatatcttgtggcaagagagagcaaagaggttacaggctctttataacaactagctctcacaggaactaatagagcaagaactcacttattaccatgaggatggcaccaagacattcatgagggatctgtccctgctaacccaaacgccaccaattaggggctaccttcaacactgggatcaaattttgacatgagattttggggaacaagcatccaaactacagcaccacaggtctgtctttcccattttgtgggcagtagtttgccctgtgatctcaattctctgctgtatctaagaagagttgttgatttttaatttgtgcagctttttattagttaggttgaagtgatgagtttcaagccccttatctgccagactgaaaacccaaagtaaccagagaaaattttagcctctgatacctacagctgccgcaaacagtaaatacatcctaactcagattaatataaagccacacacaaaaagcctcttcatctcagttccttttaccagatatatcatgtctgccttttaacaacaacaacaacaaaaaagcatgttaaaaatgtaatgtcacatttctatcaatgagattctttctccacttttagggtttgttgctgtttaccgtcattgttgttgccatttacttgttttgtgactttcccagtcaatttatgcaaattctgtaattttagtcatgtgaagtcactgaagattgtgtttgtgtagtttagtgattaggtaatgattaaacagagatttccttaagtgctttgaaagagtaagtcttttggcttctgcaattgggttctttgtgtgtattgcagcatgcctttaatcctcaggctgacagcttgaaactctgccttagtcttcacttcctgcttacatagagcccatggtcagccccaggtgacagaaaatggctttcttgggtgttgcaggaagtcaggaaccctgaacggtgggacctgctgaagccatggcagaagaacataaatcgtgaagatttcatggacatttattagttccccaaattaatacttttataatttcttatgcctgtctttactgcaatctctgaacataaattgtgaagattttgtggatacttatcacttccctaatcaatacccttgtggtttcctatgcctgtctttactttaatctcttaatcccatcatcttcgtaagctgaggaggatgtatgttgcctcaggaccctgtgatgactgcgttaactgcacaaactatttgtagagcatgtgtgtttgaacaatatgaattctgggcaccctgaaaaaagaacaggataacagcaatattcagggaacaagagagataaccttaaactctgaccgccggtgagccaggtggaacaaagccatatttctcgtctttcaaaagcaaatgggagaaatatcgctgaattctttttctcagcaaggaacatccctgagaaagagaatgcatccctgagggtaggcctctaaaatggccgctctgtggggtggccatcttttacggttgaagctgtagggatgaaataagccccaatctcctgtagcactcccaggcttattaggacaaggaaattcccgcctaatacattttggtcagaccggttgtctgctctcaaaccctgtctcctgataagatgttatcaatgacaatgcgtgccgaaacttcattagcaattttaatttcgccctggtcctgtagtcctgtgatcttgccctgcctccatttgccttgtgatattctattaccttgtgaagcatgtgatctctgtgacccacaccctattcgtacactcactcaacttttgaaaatcactaataaaaactttctggttttacggctcagggggcatcacggaacctgccgacatgtgatgtctcccccagacgcccagctttaaaatttctctcttttgtactctgttcctttatttctcagaccggctgacacttagggaaaatagaaaagaacctacgtgaaatatcaggggtgaatttctcccaatatctggctgaatttcccccaatacttgggtctttcctgaacacacacagagccctgcgtaggctcatgtgcatctagattcccaagaaaatgtttgagattttcaaagccccctagggatacctaattcccaagttttcgcctttaagtatttttgtcaggctcattagcctcagctgatatcatcacctcacacaagtatgatgttaaacaattgctgctaattttttattttcataatcaatgccttggtgatggggctgttcccacacagtgaactctgaatcaagtcaaataaatacaagccctaataatagagcatctccagggagctttcaaacaagccagatagtgacaattctctggggatgatgctttgtagggggctctgaacgtcttctgcctcctccaaaggctgctaggctgctggttttcatacctgctgtggttgggaggctgttatttttcaaggctatggcagcactggggagatggggatgggaacaagaggagagaaagtcatgaagtttgtagttcttactgagattcagccattttcttgaataaatacatacatagccaaagaactgttgtaagcctttgattaatgcccagagttctgaaacgttgattttcatgatttttgccagtgttctcattgcttttgtggaggagttgatttcctgaggtccttattccagcattctagaagtgcttttcctgttttgtgctaatggcatctattttggggtgattaattcacctccattcgaaactctcccagtcatgatgagagctacttgataggaaagcactgatgagaatcatcttgctggaaatgttttactatccctacctgatgctctatttctcttcgtgtctcttttcttaaatgtagctaaacatagataacaaataaaagaaactttgtcaggatacaagagcacgaatgctagatcagttaaccagaaactcccaaggatgaaaccagccagctcttcgggtctaaaaaattgaaatgattcaattgttatcactttcaggtagatatagttttccttctaaaaagcatttaaagtgaaaataccatgttacttttgaaaatggaagtcattgcaagatcacatgtttcagagtgagggtaaagtaactgtttttggttcttctttatgtaaaaacattcaatagttatgtatatttttccttaaaatagtaagatatgaacataagatttttgactttaggttgatgctctgttaataatataaacaaacatttttaagaacgttttaaatccagatttaaggaagttaattatattaaaagtggtaataataatttagcaatgttttaatagaaaaataattattgagtagtatttcctgtcatttaagatagtcaatattgtcataaagtttggagattatggatactttatgttatatttggcaccatggttattacataagacacttcctatttataaactaggagcaaagggaggtgatgtaattaagtgtctaaattaattctatagaacaactaaattcagaccgtaacaatttagaatgtcattattctcataagaatgagccaaagtttatcattactctctttatatttcttttaaaattgtttgcagagcaaattaattgaataagtaaattctcaggaacaaactgtaaaagatatgcacacacaaattattaatatatttaatttttttgagagagggtcttgctctattgcctaggctggagtgcagtggtgtgatcacagctcactgcaaatctaaattattgcatttaaagaatcctcctgcatcagccttccaagtagctaggaccacagtgcacgccaccatgcctagctaatgaaaaaaatttttttttgtagagatggagtctcataatgttgcccaggctggtcttgagctcataggctcaagggatcctcctgccttggcttcccaaagcactgggtttataatgtgctcctccacaaccagctgacttattaatttagattattattaattatctttcaaagcaggccacttttccatttggaaacactttaataacatgtatcaagatatgtattggtcactcatctcttcattaaacatttatttcatgccaatcgatgtgctagatgctgacaatgaaaaggtagacaaggctctcatggaatgtggtagaagatccagctctcctcctgactccatcctctctgaagttgacagaaataaagttgaagcaatttgagataagtgctacacaggaaccggaagagcctgagacataagaaaagagcatggaggaaaagaacctactatatatagtacaggcatgggaaacctctctgatgaggagctctaaaggataacacattctaggtgattcagagaatcatgttaagtagaggaacagcatgagcaaagtcctgaggctggaaagaacttggagtatttaatgaatgaaaaaagtcaatgatgcataataagaaattgagagtagaaggaagtgagaagggtgggtgtagtgagatgaagttggggaacaaggcaaggtccagatcaagcgaggcctccataggtcaaactctggatgaagttttgggttttcctttcaaggacacaggacctatgcttattcagcaaataaagcaggaacatttggggttaaatgatagcatagacaatgcttagaggttgtttccttggaaaataaaacaaacacattgcttccagaagaatttctgtcaggaaaaagacaaattttcaatctctcttttggttatgtgggtaccataaattaatttaggaagctgccagagctctaacaacactagaaacattttcaggtatctgtggtagttcaaaggccttccaactcaggtcctcatgggctagaacattttggatagtttaataatgaggtaagacagttttaggctgaaaatcaaatcaggtcttaataataattgctaacatttattgaggacttactacatatcaagcactattatcagtgcttcatgtgaattaactcatgtaatctccataaccctatgtaattattattattatcctcatttttaatatgtggaaactaaggcaaaaagaagttaggtaactttctcagggctgtgcatttggaaagtgatagaattaggatttgaacctaggtaatctggtatcagaggccacgcagtgtccaccgcacctcactgcctaatcttagggtgattatacctcacggtttggtttaggcatgctgcacacctggaaactccatcagtttatgaaggggaggcccagctgcccatgtgataaaaggctgattatatcactaggtggattcactatcataatgaggattaaaaacaaaaaacgtctttggttggaagaccaagttaacattaaatgaacttcccgatatgcataaggaatctgagccagaaaagtgcctttgagggagagagttgcttaggtcatccaatcttggaaaatggtttttcctccatcccacatcctgaaataacctgggatgactcataaaggaagtcatggaaatataagcttggaaatcagtgcctaactaaatttgttaaggaaaagatggaatggtatctgacatgagcacattttttatcatatttccaaaattttgatttttaaactgtggtgattgaaaatatattatactcatacgtgtggcctaaaactattttagaagtatgtgactttttgggaatgtttgcttgcagcagaatatactatgtgcaaatttccagtacatatcgaaactttgtatcctaaaaatttattagttatttatacatatcttttaaaaattatatgtttattaggagagcagtaaattctatcaatgaattttacaattcaatatgtatatgttaaaacataatccactaaaggaaaatactcatttaccacatctttccacatgacgtgctgataatcttccactagaaacaacacaaaacaacaagatgtgaagaaccaaaagaagtctttaaatatatgtagaaatctcatgttttcccttgaaataacattttctaccttctaaactttatgttgtaacttataggagtgaatacacattgttatgaatcttacagctatgtgtttatttgtcctggtataattgaattagattctggaattttttctgctaatgatggcctataataaccgaatgattaaaaaaaaagagaaaagaggaagaaatagaagtgagtgctgaaaggacacaagaaggcaaaagcataaatcagaagcataaatgtgaataatatcagattaatatcaggttaatactgatattacatggagcagataacaattcactggatatacatgtcagccaacaagtagccctgacatatcagagttgccttggaattaaaaccatattattgcagctgtattagattcccaaaagataagcccagtgctctgaaacattcattgtgaaatattctagattctagacattttcagttagtagaaaatccttgaatcattgctaatttccactttaagttttcccctcttctatgtgatcaacagttttagtagactctgttttccattccaagtgataacatagtctgataccttttcaaatacatgccttgattagttggttagaaatatttactatgtggataaatatattaaaatatatggatatgttctaattatacaagctatttttctatctaattgatattaacaagacaatactttttaaaacttgtgtagttttctacaaacatcttcttctctgaaatgtgaacacggcagcttttttttctaaaaccaatttagaattattctttggactgtcaactgttcagagacaattttgttaattttagactgcacactaaatatgcagcatatttgtggctagaaatacaaaatgtagttaactttatttcttataatgattatcttcattgcttttcaaactttacatcatataatcaattttcaaaacagtttgatttgttggtagtaatttgcattttgtttttctatttgttatttcacagagttaagaatgtattgtgatgatagtatgccttaaaacatcaacatatcctgattttaataaatactatgaggtctgccatttgaggagtttgatttgtaattaagtgtagtagctatttctgtttgcacaaagcataaaacgttacaacatgttcaagtttaagtcctttgttgcatcctaaatgattcactcattttccacagaaaagcctcaattacaaagaactaaaaaaattaaattaataatcagtggaagagaagtaggtttaaaaaggatgctcaaactatattgaaaaaaaggatatgaggctgggcggggtggctcacgcctgtaatctgagcactttgggaggctgaggcaggcagactgtttgaggccaggagttgaagaccagcctggccaacgtagtgaaatctggtctctacgaaaattacaaaaactagccaggagtgatggcgtggcctgtaatcctagctacgttgggaggctgaggcaagagaattgcttgaacttgagagttggaggctgcaatgagccaagatcacgccactgcactctagcctaggcaacagagcgagactccatctcaaaaaaaaagagaaaaaatgtatatgaaaaacatgttgggaattctccaccggagagaacacaaacctacaaatacgtgaagaatgaccaaaatggtcttttggaaaatgttgataagggttgatggaagatcaatgtagtatatttggaacattctggactatacaacactaaatggcccttcactgtaggactactcagagcctgtgatatgtacattgttcattactgagaagctacatataagagcaagcagggcttctgaaatagttttgatggtggaaaattgtttgtttcttggtagtgcacctcatagaagatctgtgacaaatgctttgggacatggtgtggtacctatttatgtcaccaactttattatagaatacatttattgagggctcatttaaatctcaggtcaagtgatattacataaatttcaactctctattaatatagtcatttatctttgcaggttagcttggaacaaaataaatttcaactgtttttgtaaaatataaattctgagttaataaacaaaagattttaattttaacttttaaagtctaattaaaatttccaacagcataaattaatgctgcagaatagagagttcagaaatagacctatgcagatatgctcaattactttttgataaaattacaaaggcatttcagtggatttcaccaaaataaaaatttctgctctgggaaagacactgttaagagattgtaaagcaagccacagattgagacaaaggtttgcaagtcatgtgtctaataaaggacttgtatccagaatatataaagaactttcaaaactcagtaatcagaaaataacccaacttaaacaatgaatgaaagatttgaacaaacaattcaccattgaagatatggcaaataagcacatgaaatggtgtttaatattgttagtcactggggaaatgcaaattaaaaccacaatgaaatgccactacatatctattagaatagctaacataaccaacgaagaaacagtaccgaaaacaacaatgacaaaactgacaccaccaagtactgaccaggatgcagggaaactaaaactctcgtacattgtggggagtttaaaataataaagccactttgaaaaataggttgagagtttcttataaagttacatgttcacttatgccatagaaccagtaattctacttctagctatttaccgaggagaaatgaaaacatggtcacacaagaaccttttcataaaggcttatagcagctctattcataatcataaaaaattggaaggaacccttcagtgagccaatagataatctgagatgcattcatatggtggaatactactcagtgataaaaagcaaaaatattgacacataaacaatttgaacgcatctcagatgcaaaagaaactatactcaaaggctacaagatttcatttacattgcatcctgaaaaacgcaaaactataggggatagaatggttgccaggggttaaggatcaggaatcttgattgtggcggtggttataggaattgatgcattttccaaaattcataaagctgtactttaaaaagagtaaattttaatgtatgtaaatcaataataagttttaaaaacccaccgaaagatggagaggaaggaggtaatttaaattcctgtacagaaggttatttggcacaaaggacaaatataaaatcttagccctttacatcataagtatggtaaccatataatgtatcacctgaactgggcacttgatgatgaaagaggggtctatgttatttagaatgagacaacaacctaggactctcccaggcacactgagctgtacagtcaccttaatcttaagggaaattacaaaaacacaccaaagaagctactcacatcaatataaataagtgttacttacttggccacatattaacatgtggcagctcccctggagattgaactgtaagagtcatcagattataatttggccactcttgaaccacaaggttatcacatgttgtgatgtacacaggatttgtaaaatcatatgtaggaacaattttgtagtccaaagtgatacaaaaatatctgaattatggaaacttctccaatgttttattgtaacaaacatgctaaaactgtatcacctatgcccactgtgtttgtctggtcttggttttatattgctatagagaaatacctaaggctaggtaacttacaagaaaaggaagtttaattggctcatggttctgcaggctctacaggaagggtggtgccggcatccaattggcttctggtgaggtctcaggaagctttcaaaaatggcagaaggtgaaaggggaggaagcatgtcacctggcaagagcaggagcaagagagagagaaggaggtcccagacttctttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcccccagacttctttaaacaaccagatctcatttgaactgagaactctgccatttgcagattaaatttgagtgaatgggttttgccttagcatactccttccttctctttcatttatttatgctttcagcaaccctaagtgtcatttacccagcaatgctttgtgtcatttgactgtcaactctatgcatcattcttacagaaatatttactctgtgtcatgccctgtactaaatatggaggattcattggagtatgatcctgccttcatagggatttacagtattttagagggcatgtaggggaagagaaggggcccgggcttgtaaacagtattcatccatctctcaatgtgctattttattaaaaatacagacagagcacatggaagaggggcctaatatagcttaggtcaggaaaaggttaaagaagtgacttccaaacagctttaccctgagggtagcagggagtaattgaaatgtttcaagcagtgtaggtgatgtgatatgatttgcattttagaaagataattctggctgctttgtggtgagagagagagagagagagagagagggagggagggagggagggagagagagacgagagagagagagagagagagagagagagagagagagagagagatcaggagaaaagaaatccagtgaagagacaagagactctggtggtgtgaggatagaaagggagagacacattcaagccagtcagaaggttgaatcaattgaatgggttgtggtggtgaggaggagaaactataggataacactaaggaataataagagattccatctgttagatgctccatatccatgcaggaaaagctgatatactttacagatgaagagattaaaattccaagaggttagtaatattcacaagtccaaagaattaatgagtaaatgatagaatctaagcaagttatttagtcccttcaatctatacatttttcatgtatataatgacaataaaagtggctctaactttctgtatttgctcagaacaattcctggcacatgtaagcacccagtaaagatgagctggtcttccagagtggggatgtttttttgcaggtgtgaggctatacagacccagatccttaagagtgcacagaggcatgaacaatgtatggcaaacatccttggctctcaatcgtttgcctgtttttgagggctcactggttctttctcatgtcccagatctctaaaggggaaatcctccaggacccaaaccttggatctcttctcttccatctacatcctctttctatgtgattgcacccattttcatgactttaaatgtcacgtatattctaatgactctcacatttcaatctccagttctctgcctcagggccctgtatatgctgcctcttgacaattccacatggatgtctgcagtccaaaaccaagcttctgactttctttccaaagctcactcctgtagcctgcctcagtcaggttaatgggaaattttaagttcaatttgcttagacccaaaacaatggtgttatacttctttttattgcatcccacatcagattcatagaaaaacctgttagctatgccttcaaaatatacccagagtcagactacttctcatcatctctactgctaccttcctcgtctgagccaccttcttgcttacctggattggtgcaatcacctgctaattcatcttactgcttctccactatccagctgtaaaatatgtccaacaaggtagacatagtggtcctttaaaacataaatcaggtcacgtcactcctctgttctgactcttccaaagatgtcccatgatctaagcaccctacgtgacctgtacccctgttatcttcttgacaaaattgcttacagaactccctttcactaactgctgcagccatgtgggctccattgctggtcatggaacttgtcagctgtgctcttgtttcaggacctttgcacttgtggtgacctctgcctggaaagcccttcctccagacagtgagggctagctcccacacttcctgcaatctttaccccactcatctcctgagagaagcatttcccggtctaaaatgtctacatacctaaaatgtgagctacatctaatgtttcttgttccactttcttgcttcatttttagcttttatcacaatctgaacacacacacacacacacacatacacacactctcacaccttgcttattgtttctttttcctagtagaagtaagctgcatggggcaccgacttttatctgttttattccctgctgtgtcctcagtgcctagaacagtgaatcctcagtgtttagtacagggcatgacacagagtaagagtaaatatttctctaagaatgatgcgtagagttgacagtcaaatgacacaaagcattgctgggtgaaagacacttagggttgctgaaaacataaataaatgaatgagaagggaggagtatgctaaggcaaaacccattcactcaaatttaacctgcaaatggcagagttctcagcattttaggatgaaaaactggggatgtttctaaaccaacgtcaaagttgcaattggtgaaggttaagagagaggaaaggtggaaggatctgccctattgaattgcagagtaaatattacatgaagcacttttgattctaaggctggttcagaaagtggaggtatgtaggccccatacacctggtttgcttgcttgttttgttatcgattgctgaacttaaagggtaatataacgaggcaggtctgatccttgttcacaagacacgcagtttagtaccaggtcaagatacaaacaacatcttctacacactctcctttcacactgcatttgggctacatgcccctaggaaacatctaaaattgctactgtactccaaggaaaggtaaaagagtaagacggacatcaaatcaggagccttagggactctttggaagtggggattgtgatgacacagaataactggaaataaatgacattccctgcttcctaaaattgatggggtttgcttcatgtgtatatccaagcacatccccttggaagtaatgctatatttgaagaattttagaattttctggcccgatctgcatgtttcttttcttccttgggtttacttgatggctgagtatgttttggagttttcctcaaagtctgttccaacgaacagacttatctgttggcattatctaggaattcatcacagcggcagaatctgcattttaacataatcctgaagtgatttgtatgtatgtaaaaatttgagaagctttatttcagaggactatcagggaagagcaaaacctcggtgcttctcaaactacagtccctggaccaaaaccatcaggatcacttgggaatttgttagaaatgctgatttttaaaactttatttttagattcggaggtacatgtgaagatttgttaaacaggtaaacatgaatcacaggggtttggtgtacagactatttcatcacccaggtattaagcccagtacctgagttaccttttctgctcctctccctcctcccaccctccaccatcaagcagacgccagtgtctgttgtttccttctttgtgttcataagttcatatcatataagtgagaacatgtggtatttggttttctgtttctgcattaatttgctgaggataacagcctccagctccatccgtgttcctacaaaagacatgatcttgttccttttcatggctgcatagtattccatggtgtatatgtgccacattttctttatcccatttgtcattgatgggcatttaggttgattccatgtctttgctattgtggatactgctgcaatgaacatttgtgtgcatgtgtctttaaggtagaatgatttatattcctctgggtatatgcccagtaatgggattgctgagtcgaatggttattttgcttttagctctttgaggaatcaccatactgctttccacaatgattgaactaatttacactcccaccgacaatgtataagtgttcccgtttctccacaccttgccagcatctgttatttcttgatgttttaataatagctagaaatgcagatttttagctctatctactaaatcagaaactcaggtggaatctactactctatattgtaacaagacttctaggtgatgctggtgctcactaatgtttgaaaaccactgatttgggtggactgcaagattcaatcaaggtgtggcgtaatggcagtcaggagatgaggatgctggatgtattgtcagctgcaattaattagctgtgtgaccttggggaagtagcttgactaattaactggatctagtctccttagttgcaaagagaaaaagatatcaattccttggagtgagagttctgcaagtgggatttatgggggcccaggtggtttattgagggccttatcagaaatttagttatctcagaaataaaaataataccacaaataataaaaataataagcaaaagtgttttgtgcttaaacatattcagtgattttgaaatataggatatgaatgttatagaaatattataaaatcctccttcccatatgttctgaggtctgggctacagaagcctgattagttctcagtaacttttagttaacagggtgcagatcatttcactaatgtgttttcacatcattttcttattgccattttcattagttaatttcccacttttatttgctacagttatactatgttataattgcaatttttaataatggttctacggctcatgagtggctcattgatactttggtttttttttttttttttttttggcatggcatctctttctagattgctactttaaagtgccaatacaataactacataagtgtgatttcagaattacactgatgatgcaataaatagcactttgaggtgaatgtaagatttgaatctgtttaggtagagacaagtgaatcttcaacatgaagattttacatggcagttgaaagagtgtcatgtgaaataaaaaaaagatcatctaaatattttcttagttttcaccatgctgtctgttatgaaactttgagaatatgccattatatttgtagcttttctcattgacaaaaagacaaatatcatattctatccagaagcttattaataaaacattaatgacatataacatctcagtagaaatgagataaaaactcttgctggattcctttgtgacagcattgggtgatagtataatcccagtaatttgtaacatggaagggcacctgctcatattctcatgcatatgctaagatggatgaatgcggtaagatgcaagccatgaatctactttgtgcacacacacctagcacacagatgatggaataatgctcaatggctttatttttatttaaaattttatttgtatacagttatgggttacaaggataattttgttacatggatatattgcatagtggtgaagtcagggcttttagtgtatccatcaacagaataacacacatcgtatccattaagtaacttctcctctgtttctgcttgggcagtagagttttattttttttttatttcatgtgatatccccaagaccagattctccacaacacattattatctccagtatcaaaatgtatcactgcacagccaaatcactaagatttttcaagatcaaactgtggagtagatggcttgatagacaagagtctgacttgtttccccaaataagttgactttttcacctttctaagagaaaaatcaataatctcattggccattacacacacacacacacacacacacacacacacacacacatgttgtaaccgaataagaagaatgctttccagagcccaaaacaaccagagtgattaagaatccattagctgccatctttcaaattacttattcaatcttacagcttttgaatggatatgatcatctgatggtgcactgtagtcttcagcgaaatcctatacacaatttcttggtccatccatgttcagtgagactatgtaaaactgttggagccaagaatctcatgccaccacttttacctctagtttcatgttcatattttatccacagtttacataagtcctctgtttagttttcctgaatttatattcatggaatcaatgttttgcagcacacacatttttaaggaattaaggcctatggagtctttcaaggaaaccaaggattgctttccagtttgaagctgctttcctctttttgtgttttctatggacctaaagaaatgaaaactctcagttgagattttcaggaaagtacctgactactggctgactcaataagttgctatgagaaattaaatatgcaaatcatttttacatgcacatttatatagggaaaacacctgcacacctggatccccagcagtctctgctgattaatatgcatgtaaccccgaactgcccgttgctgggtaataagagttttaaatgtacttggcttattttcaagtaaatctctgggtcttcagtactgcaattaaatgtgccaggttagatgctcatttcatgtcaaatccacttcctaccctatgaaagaagttctatttttgcatttaataggtattttgtctttactttggaagaaaaaaaaagactcctgttaacagcaaacaatgagatttacaatgtaaagaaaaccacccggtaaactagaatgttttacagagtgatttaaaaaaataaaaaggttggggaagatggttctgccatgaaacagctgaaagatcaaatgtaactgaaaaacactggggccaggttgcctctgatgaatgatatctcctttttgatagtgtacttgtaaaattcaggttatacatgcaccattttatttgggaatctacaaagctttggagataggtagcaacaagttggttatttttttaaggtggagaaattgaagcttggcatcccagtgtcccattcaagacgttccaagcagtagatggaaatgcaggtgagcagtagagttcattcgaattcacttcccttgttcaggcccctcccgccgtgccattgctattctttctgcgtgggtattgctcattcttcgcctgagagtatttattctatcttcactagaaatgaaagctttaacctatgggcttttcatttaaataacatcatttacattttattttatttttcaaacaggtctccagggacagaatctctgggaattaattatgtaccacacaagactctaaaaaatatgaggttcaaactggctgatgttacttatggaaatgggctgccaaataaaacaatctaagaaatatttaacagtgacatctgacacatcttattccaaattaggtatcacatatcttatgacagtccaacagaaagcagagttttattgtgcatgttttgctttaaaagattattccttttgcacctcagtaatacaaataacagtttataagcatttatactctatcattaaaaactcacattaatataagactatactaatagaacctagtttaaacacatgtgtatttgtaggtttatataagttcatatgtcaagcattagataattttaattgctcaacgtaatctttaaaacaacttaatgagataagtagtagtatttttattttatacatacaaggaaagtgaaacctttaaaaagtgaggcaaggtgagtgactcattcaactttactgggcttttgcctgtcccttttgaccctgccaacggaagtatttcttcctctgtccttttttccacacatttcaccttctatttacttaaatatacttttgttcttctgaactcaagctagtatttttgatatggggaaggcaaattagtaaagaaaggcagttgatatttagtccaaaaataagcaacctagttaaagaacataaaagagataaaatattctagagttggctctaattttctgttttttgctttacaaaccagttttattttacattgccaatgacttttggagtcactctcttcacaccactttagccacccattgataatcacatttttacatctgtcagtgaaatttactcagtcctgatattgtcaatttagacactgcgttcccagatcacaaccttcttttctttcaattctctctattctttccaagaaatcagcctttgcctacactcaggactacagtcctttctggtttccctcccaggctcctctgtcttaatttatttcacttttcactgctcagcttagaatttgcttctcttcaatcactgtcttacaaatattctgaactcccttgacctcttaaccttttcttgcacttgactgaccaaattccatctatatttggacaaatcccagaatctacctttttcatatgcagacttctgggaagtgctgaatacaactgtgcaaactaaggctaatatatgattgtggtcactgacctcaaatggcttgttctttttctctaataatactattttcagttttatatagtctcttttgcttattttttacagcacttaagtaaaatattctccactcttgtcaaggcttcatttccttatctcatcatcatcttcagagaaaaaaaactagaagtaatcagaggaaaattacctcaaccttcttccatcaagtccaagtatttttctttcctgcactgtactgttttagttggggttttgctaaaaccaaaggtgaggtaacatagaaatgctaatgctttataggaaagtgtaatcccaagatggtgtgagtcagaggatggtgcaatggtttgaatgtttgtgtcccttccaaaattcatattgaaacttaatcaccaatgcaatagttttaagagatatgaactttggaagtcatgaggactctgccctagtgactggaattagcatccttataaaaggactcaatgttgaagggagctctcttttgccctcccatcccttccagcacgtgaggacatagtgttccttttctctgaaggatgcagcaagaaagcgccatcttggaaagggagacgaagctcttaccagacaccaaacctgctggcaccgtgatcttggacctcccagcctccagaaccatgagaaataaatttatgttgtatgtaaattatccagtctgtggtattttgtgacagcagcacaaataaactaagacagatggaaagcagatataggtgatgcagcattcagccatctgctgctttgtgagatgcaaagtcactcacccaagtggcctctcccttgaaaacctgtacagaacacaggtattccagagtagaatgaggaatagataaggacatttccaatggttcctgctcatcttttgccttttcatgggccaaagtttgcctcagaggcagctattttgtccacacctctctattgtggcactcggtaccttttcaaattttattttccgtttcctttctatcctctcctttttaaggcataatttacacatatatttgactgcttgaagttccccatagttcactgatatcctttttaatctttagagctgtttatctctctatgatttattttggacaatttctatttgctatgacttcaagttaactaacctttcgttctgcaatatctaagctatagttgttttcctatccagtgtattttgcatctcagacactgtagttttcatccctggaagtttgatttgtatcttttcatgtctttcatgtccccacttaacatattcaatctttcctctagcttctggagtatatggagtagttaaataacagttttaaggtccttgtctagtacttttatcacttgtagcatttctagatgagtttctattgatttttctcctatgggttacatttttctgcttttttgcaagcttggtaattttttgttggatgccagatattatgaattttagcttattgggtattagattatttcttttttatttttttgagacagggttttgctctgtcacccaggctaaagtgcagtggtgtgatcacatttcactgcagccttgacctcttgggcacaagtgatcctcctgcgtcagtctctcaagtagctgggcccacaggtgtatgccaccacgcctggctaatttttgtattttttctagagacagggtttcaccacgttgctcaggctgatctcaaactcctgagctcaagcaatctgcctgccttggcctcccaaaatactggtattacaggtgtgagccaccatgcccagccaggtgctggatcgatccatccttccttccttccttccttccttccttccttccttccttccctccctccctccctccttccttccttccttccttggagtctcgctctgtcaccagactggagtgcagtggcgcgatctcagttcactgcaatctctgcctcccgggttcaagcgattttcctgcctcagcctcctgagtagctgggattacaggcacacaccaccacgccaagctaatttttgtatttttagtagagacggggtttcaccatgttgggcagggtggtctccatctcctgacctcgtgatccgccaacctcggactcccaaagtgctgggattacaggggcgagccactgcgcccagcctggattatttccttctaaaactattctccagctttgttttgaaacaaggttaagttgctttgaaacactgtggccctttcaggtcttgcttttaagctttgttagtgaggactagagcagtgtttggtctagggttaattttcttcactactgaggtgctctaactgagtctttaagttctccatatgttttcacctactccccaaaaagcatgtagtatgactggcttaggtatctgtgcatgggctccccaagatcatccccaaggttcatgatttgctaggagaactcacaggactctctatatgctgtactcactgtgaagatttattacagcaacaagatagaaatcaaaatcaacaaaggaaaagggcacttggggtgaaatctgaaacaaactgggtgcaggtgctcaaagacatctccaagtggagtcacacaggatgtgcttaattctcccagcaacaagtcaggacaacatgtgtgaaatattgtctaccagggaagctcattacaaactaagtgcccaggggtattcttggggtctggtcttgtgggcagcttctgtctgccgtatacctagatttcagactccccaagagaaagcaggtgtttaaaaataaagcacattatttgtatgagtagtttaggcacaatgaaccagtcttatcggggaacagttgtaactctcacgaagtccaggagcagccttgaaagcaggtatttgcaagttatcacagcagttccagccctgttataatagctcttctgcacagtgccgatcccttaagtttccttagcaccttatatttctcctataaacccactgttcaactgcctgtctcccacagatggtaaactcttttctctgtgagaaaagaaggcaaactctgagcccgtgagaaaagaagaaactatacttcactcaatattgcgcctcctgtacctagcctaaagcttggcataaagtggatggtcaaaaatacttgttaaatgaagataaaggattaatattgtgagaccatataaaactcttaagattataaagatacatgggcaaaggacataaagaaatcaatattcactaataagcaaatcatctgattttaaaaattaggagttctttctaatgtattaaagtgacaagggtcaaataaatattaatatacgaagttaaggatatggataaatggtaactgttatccattgccgaaaataatatgtaagttataaatgactgatttagtaatgtatatcaagaatttaaaatgttcattaccatgtctcgggaaattccacttataataatttatcatataaaacattaagagataaaaaaagaaaaaagatataaagatgttaattgcagcattatttaaaatggtatgtatgtgctaacactacaaatgtccaatgatagaaggttaaataaattaaaagatataaatacaatgagatattaagaagtaaaccatagattgctttcaataaatactttatgaggacatgtaaaaacaccacaatgcaataagtgaaaaactcaagatatcagtcaatatattttgttccaaattatgtgtatatatgtgtatatttacatataagatatgtattattaaaactacaataaagttgggaaatatatatgttaaataatattaactacttgtgaagagtttaatcatggggtcactgttcttttcttatttttctttttaagtgcttttcaaatgggtgtttttgtaataaggatacacatatgtatacttgcatacatatacattcatacaaatgaacatgtatttcctaatttgtttcattatttcattattgaataataactactgtggggagaggaatctcaaattaaatatcatatgtgaagcacacaaataaaaaaaattatacttgtcattaggagaggaccaattctcatcagagacatttgggggaactcactaagtcttagttggtacttatccagtactactcaccattatcaatattttatttaaaaatatacttctgaacatgtaattgtttcatttcagaaattaaacactttttcaatctccacacagctgagatttctacttccttttcatgtgatcttagggttatgtctatttctgaaggctagtgtatgaaagtattcatgagatattttatactgtctttgaaattttgattttactatctttcataagttttaaaatatttgcttttaaaatgggagtgaaaagtgcaatcatcaaaggttaattaaatttctcccatctggaaatatgaatattctgaatatttacataggattaaaagatttagacacatacatgcacatacacacacacaccagagacagagacagacttgtaacttctacttccaaaaccctaataaataagattatgtaatttgatgacagatgatttattaaacagcatctttactgacaagttgtattctctgcaacatctgtcattttcctatctgattatgtttccatctcattcaaaccattatagacaatgaatattttgattagtcatgttgggatactgaattatatctaaaaccaagctgcttctctgtcctggtttggatttctcctagagcaaaccgcaaaccaaggacttgggtgcaagtaacttgtttgggaggtaatccaaggagacatattgaggacatggggagtgagtcagggaatcgaggaatgcttgaagcaggtgttcatgatcaggctccttctgagggcaatctggatcttgttctctctggagaccaccagacagactgtgtggaacatgcctgggaaatgacccacttaaggacaaggaagtgaataagtgaataaggacagtgaattctttttatgcaccaacacttctctatattatttgaaggtcatcaaagggacattgacttccggcattttcagccatccccatgaccaggctgcaaatgccaacaggcagagaggaatggcgatgctcggtggatgggaactgtctgtgggagacttctgggtgtggaggaaggccccgaccacccctctgtgtggaacaagacatggccagggaaaagaagtgatgctttcacttttattcttttgcagagtcactagctctgacatcagtcttagcacttaggagcccagtgactttgagccagttataaatcctcccaaaccccagtttttctcatctggacttaggtttggtcagaacaagtatctgaaacttagaagtaggcaaaaagattagtagatattccttcagtgttatgctgggcttgattttctattagcttggctattttacaactctgtagggacagaggttgatttgtagatttttgtcctatggaatgcaaataatttctatttgatagaatagagcaccccaaagctgacagttatgcttctcttggacattattccatttggtatccaacccagaagtcttatcctagtattgcctacaaacatctggcatttaaatgttctttgaactggttttaatatgtcaagggacttttgttaatgaatgaattgaataaaaatatttggcatgtactcattttacatttacctgagagtcataatttttgcctctttgaaaactatactttcacagttttataaacttattttagctgtgagactctcccatccaagcctccacggacccactatatgtaaaatggatgagtatgcaggaagtggtatatgcaggaagtggtgaatatgcaggaagtgagtatgcaggaagtgagtacacaggaagtggtgacctgcccacctccaagcctctcacaggctgctgaggaatctctttgcctctttggaattgagttttttaattgctcttctaaatgattctcacttgtcttttggtcctttctttgtttcaaaaagctttcttttacagaaaagaaaattgtagagacaaagaccacccaaacgaaaattaaacagattatttagttggagcttgctatacaaaggagtcagccaccatcacttgtgctccacatggacttaaagacaggcagaggagagggaaagcgtacagggaaaaggaggaggcttcaggtatgccctgattggaggctgttggcatgggaaagctggaggtgggctgactggaggtggagttccaatgtaattgagttggggagcatattttactttttttgtgttgctctaagtaggaagtgggaggacagtggcaaaaattagggaagctgtcagctattaagtactgactactttgggctgatggctacagaaattgtgatttgacttcttggactggctgctgcagactgtggggcaaagttctctttttatatatgatctggccattgtccatttgtattttcagtccatcaaaatggaggcttaagtgtattgagttgcgtgaggttctgcactcagtggctaaggaagactatattgcctgtgaattctagccttagcttaactgtaaagaacaaagtaaaacaaatccctgaggcccagaccaagactaggaaacaacaaaaactaggagggcagattaaagaggaggtagagagagaaattgagatagaaagtttattcaaagggacaataatagagaactccccaaacctagagaaagatttcaatatctacgcacaagaaggttaagaataccaagcagatttaactcaaagaagactaccggctgggcgcggtggctcacgcctgtaatcccagcactttgggaggctgaggtgggaggataacaaggtcaggtgatcgagaccatcctggctaatacggtgaaaccccatttctattaataaatacaaaaacattagctgggcatagtggcaggcacctgtagtcccagctactcgggagcctgaggcaggagaatggcgtgaacccaggaggcagagcttgcagtgagcagagattgcgccactgcactccagcctgggcaacagagcaagactccgtctcaaaagaaaaaagaagactacctcaaggcatttaataatcaaactcctaaaggtcaaggataaaggattctaaaagcagcaagagaacagaaacgaataatatacaaagacacttcaatacttctggaagcagcctttgcaatggaaaacttacaggacaggagagagtggcatgatattttttaaatactgaaggaaaaagacttttatcctggaatagtatatccagcaaaaatgtccttcggacatgaaggaaaaataaagactttcctagacaaacaaaagctgagggatttcataaacatcagatctgtcctaagagaaatcctaaagggagttcttcaatcttaaagaaaatgagattaacaagcaataagaaatcacatgaaggtacagaactcatggataatagtaagtacacagacaaacacagaatattataacactgtaattgtggtgtgtaaactactatgttgagtagaaagactaaaagatgaacctataaaaaatagtaaataactatttactaaaagtaaataaagtaaatagtaaatagtattactatttatatatataaagtaatatatatttatatataaatatatataaagtaaatagtaaataactactaaaagatgaactatttactaaaagatgaacttatcaaaaatgtaaataactttttatatcttattatattatatatattatattatatattttatatcttatatattatattatattataatattatatctgattatattataatatataatataatacatatcttatattatattatatatttttatatcttattatactatattatatattatataatgtacttatataattatatatgacatattatatattatatataacacttatataatatataattatatatgttattatatatgttaatatataatgttattatataatatattatatataactaattattgcaatcaattattatatataattataaatattatataattataatatctattatatatttactcaaaagttataactatttattcaaagttatttttgaagatatagacagtataataagatataaatagaaacaacaaaagagtttaaaagtgggggggatggagttaaagtgtagagtttttatcagttttatcagttttctctttgcttatttgttttgtaatcagtgttaagtattcatgagtttaaagtaatgggctataagatgtcatttgcaaggcttatggcaacttcaaataaaaaatacctacaacagatacacaaaaaataaaaagcaagaaattaaaacataccttttgtgaaggagaaaattaccttcacacaaaggaagatagcaaggaaagaagaaaggagagtagagcaaaagacaatcggaaaacaaatagcaaactgagaggagtaagtcctttcttatcaataataaaattgcatgtaaatggactaaactctccaaacaaaagacatagagtagctgaatggattgtttaaaaaagaaccaacgatctgttgcctacaagaaacacacttcacctataaagacatacatagactaaaaacaaagaatatcaaaaagatattcaatgcaaatggaaatcaaaaaagagcaagagtaggtatatattggacaaaatagatgtcaagtagtatctatcagacaaagtttcagtagtatctatcagacaaaatagaattcaagacaagcactataaaaagagaaaaagaaagtcattatgtaatgataaaggggtcaattttgccagaggatataacaattttaagtatgtatgtacacaacaatggaacactagatacgtaaagcaaatattattagagctaaagagagagatagaccccaatacaataataactggagacttcaacatcccacttttagcaatgaatggatcatccagacagaaaatcaactaagaaacattgaacttatagaagatctgtgctatagaccaaatggacctaatagatatttacagcacatttaatccagcagctaaagaatacacatttgtctgctcagcatatggatctttctcaaggatagaccatatattagaccacaaaagaaaaaattgaactcgtattaagtatcttctctgaccacagtgaaataaagttagaaatcaagaacaaaaggaattttggaaactatgaaaacacacaggaattaaacaatatgctccagaatgactagtgggccaatgaagaaattaagaaggaaattgaaaaaaattttgaaccaatgaaaatgggaacacaatatactaagacctatgggatactgcaaaagcagtattaaaaggaaagtttatagcaataagcacctacatgaaaaaagtagataaacattaaataaacaacctaatgatacatcttaaaaaagtagaaaaggaagagcaaaccaaacccaaaatcaataacaaaaaaataaagatcagaacaaaagtaaatgaaatttaaataaaaaaccttaaaaatttcatttcaaaccaataaagtgaaaacttatttttttgaaaaagtaaacaaaattgacaaacatttagccagaccttcagaaaaaaaaaaagagacagagaatacccaaataaacacaatcagagatgaaaaaggagacattacaactgataccacagaaatttaaaggatcattagaggctactctgagcaattatatgccaataaattcaaaaacctagaggaaatggattaattcctagacacatacaatttaccaatattgaaccatgaagaaattcaaaacctgaacagactgataacaagtaatgaggtcgaagcctcaataaaaagtctccatgcaaagaaaaccgtgggtcccaatggcttcactgctaaatattaccaaacatgtaaaaaagaactaataccaatcctagtcaaactattccaaaaaatagaggaagagggaatacttccaaatacattctacaaggccagtattaccctgacatcaaaaccatgcaaatacatatcaaaaaaggaaaattacaggccaatgtccctgaagaaaatttatgcaaaaattcttaataaaatactagcaaatctaattcaacaacacattaaaaagattattcatcatgaccaagcgggatttatcccagggatgcaaggatggttcaacatatacaagtcaatgaatgtgctgcatcatatcaacagagtgaaagacaaaacccatatgatcatttcaattaatgctgacaaagcatttgataaaattcaagatctcttcatgataaaagcctaaataaactgggtatagaaggaacatacctcaacacaataaaagccatatacaacagacctacagctagtattatactggatggggaaaaactgaaaacctttcttctaagatctggaacaagacaaggatgttcactttcaccattgttatctaacatagtactggaaatcctagctagaacaatcacacaagagaaagaaatagaggtcatctaaattggaatggaagacgtcaaattatccttgtttgcagatgatatgatcttatatttggataaagctaaagactccaccaaaaattattagaactgctaaacaaactcagtaaagttgcaggatacaaaatcatacaaaaatcagtaacatctccatatgccaacagcaaacaatctgaaaaagaaataaagaaagtaaatccatttacaaaagctacaaatcaaataacatacgtatgaatttacttaaccaaagaagtgaaagatttctataataaaaattataaaacactgataaacgaaattgaagaggacaccaaaaaatggaaagatatttcatgttcatgaattggaagaatgaatattgttaaaatgtccacactacccaaagaagtccatagagtcagtgcaactcctatcaaaatcccaatgacattcttcccagagtagaaaaaaaaatcctaaaatttttctggatccacaaaacacccataatagccaaaggtatcctgagcaaaaagaataaaactggaggaatcacattacctgacttcaaattataatatagagctatagtaaccaaaacagcatggtactggcataaaaacagacatatagaccaatgaaacagaataaagaacccagaaataagtccatatatctacagtaaactcatctttgacaaaggtgccaagaacatacactggggaaaagacagtctcttcaataagtggttctgggaaaacttgatatccatatgcagaagaatgaaacaattcctatctctcaccaaatacaaaataaaatcaaaatggattaaagacttaaatataagatctcaaactatgaaaatacttagaaaatacattggggaaactctccaggacattggtctgagcaacgatttcttaagtaataccccacaagcataggcaatcaaagcaaaaatggactaataggatcacattgagtcaaaaagcttctgcatagtaaaggaaacaatcaaataagtgaagagataaccacagaataggagaaaatatgtgcaaactacccatctgacaaggggttaataaccagaatatataagaacttaataggaaaaaatctaatccgattaaaaatgggcaaaagatcggatggacatttctcaaaagaagacatacaaatggtaagcaggtatatgagaaggtgctcaacatcattgatcattagagaaatacaaatcaatactacaaagagatatcatctcactccagtaagaatggattttatccaaaagaggtaataatgaatgctggcaaggaaaaaagggaacccttgtacactgttggtgggaatgtaaaatagtacttccactatggagaacagtttgaaatttcctcaaaaaactaaaaatagaacatatgatccagcaatcccactggtagatatatatccaaaagaaaggaaatcagtatatcagagatatcagcactccaatgtttattgcagcaagattcacgatagccacgatttggaagcaacctaagtgtccatcagcagatgaatggataaagaaaatgtggtacatgtacacaatgtagtattattcagccatacagaagaatgagattctgtcatttacaacaacatggatggagctggaggtcattatgttaagtgaaataagccaggctcagaaaggcaatctttgtatgttctcacacatttgggagctaaaaattaaaacaattgaactcatggagacggagaatagaatgatggttaccagaggctaggaagggtagtggaggtggggggacagtgaggatggtcaatgggtaaggacatctagttttgacagatgaataagattatatatttgatagcacaacagagtcacctgatagcacaacagactttaggtcaataataatttgttgtacagttaaaaataactaaaagaatataattggattgtttttaacacaaagagaggataaacgcttgaggttatggagactccatttaccctgatatgattactacacattgtatgcctgtattaaaatatcttatttactccataaacatacacatatactatgtacccacaaaaattaaaaataaaaacaacagcaactacaatataactaggaggacagagcagaagaaatggaaagggcagcttgtgaatgcgtgtgagagatcctagggccttccacagattaactgaggcttcaaaaaaggcagtgaggactgaggactgaaggtttacttgaagttggagaaagtcttggtgtttatgtgaccactgaaaccccaaggatgatggttaattttagttttcagcttgactgggttaaggaatactgagataactgataaagcattatttctgagtgtgtctttgagggtgtttatggaagagattggcatgtgagtcagtggagtgagtaagatttgcctgcaatatggacaggaagcagccaatcagctgggggcccagatagaataaaaaaggcaggagaaatgtaattcctgccctgagcctctctgagcacactttcttgcctttctgccttctgccatgggatgatgcagcagaaagggccctgctggatgtgagacccttgaccctgaacttcccagcctccagaacagtaagaaataaatctctattctttataaattatccagtctcaggtattctgtgatagcggcacaaaatagactaagacaccagactagtagaacccatgggaatgaagcttacatctatatttatacttgaattcctcatgttggacctgtcataccttcccttttcaggaatctgcaaatagccctttacatccaggcttggtttcctcccttatctgagaacagcattacaaacagaacaaaagtacctagtgccatatggacagaccaaaaaactctttgatcagtcattccactcaggtatgccagcctgttcctaaaccagggatggtaatgaaagtaatttaacatacatctataattaattggttacacttttcctgctgctggcaaatcatactattttagaaaagttcatggaattaatctcccagaagagagatgatgtggaaagccttcagaaataaatggttttgtttactcccaaacatctgagttttaagaaccaattttaactataggtcagggttaatttagtgtttcaaatttgtcttttagaaagctgtataaagtcaaatatcttcttctccccaccagatatacaggatatctacagcataatagcatagaaatcattttccttgtcagatggttcctataatctgttaagggcaatagataagatttttttaatagaaagaaaatatgaagataagagatgttataaaaaggcctttacatttatttattcaacttgatctttagacaaaagagaatattgtgtattcctggtgaaggtgttacttagtgttttagaagtgatttagaatgaaaaaagtatatgctcattaagttcagggttgattaaaatttgaccagactacaaagtagggtgaccaattgatcctggttttcctgggactttcctgattttagcactgaaaattctgtgttcctagaaatccctgcagtcctggaaccattgctcagccaaccaagatttcaaagaatttgagtttaaatagattcaattttgaaaactgatgaatggaattaagtaagggtaagtccttaaggatggaaaatagatatgcaaaatatgacagaaaaaaattaactgtagaaatacagcaatcagaggatcatagactgcacatgattcccagaattgaagttttgaagataaagagttgcatctcatttaatatcttgctagcaatccaagatatgataagacatgactcagattctttcatcctactgtctgcttcttccatcacactctttttgcttggttctaagaacatctagagcagtcgttctcaaaactgctgcctagactagtagaaatagcaccacttggacatgtgttagaaattcaagttctcaagcttcagagttactgaatctgaaactctggagaaagggacagaaatctgttgtagcaagcctgccatgtgattctgatgcatgttaaatattaagaatgactgatcaagagcaatccttcctaatctttttaaactatggatacatcaaaaattataattttatatataacacatggggcaagtgggtgaggctacttcaggctctagccaggggctaaagtgtcactcagcttacctgcaatccattaggatcacttgtttctgcataccagataacaagagactagattgctacacctactttcaccatattcctgctgctctttcttacttgtgttaccagtcaaggtggtacctgtaaccaacagtgatttcctccatagacctgaagctgttgaaaaattcaaccataaataaatgacttcataattttttgtgcagagaaaccaagaaaacggaaatcaacctaagtaatagatctttgccccaaatgaatttccagaaacagagcgtcctggggcattctttgggataatgtagtcaaggaacagtgaaggaacagaactgtagaccagatgagtcacgctctgttatttttctcatcttgcattgcatctttttctgtttaataggttccctcttgtcttttccagaaaaatgtataggtttgtcaccttttttagtgtccaagggggatttggcccaaagtgtctgagagggggccgctttactcatcaaagctgggaattaatcttagtaacaactagaggtcaaggtgggaatctggcagtgggtgctcaatgcctaagaggacaatgggttgagaccacagctcagtagaactctcaaccacttattgtaaggatctcaactccagagaggagtaaatgatttcaacaaactaacttgtaatttaggatggatgatgtcaatacatcaaccaatatgtggggagttgtgtgacaaaaacttagccttaaactaaacatttagatattctcacactgaaaagtatccagaaacatattttaaatttcaacaagtacagcagactctttccagagaggcttgagtttactttgcacatggctttctgaaaatgtatgtatctcagctccaaaacagaaactttctccaatttgaagaagcatttaggcccatttaaaatcattcagctatgaactaaattggacaaagaatgcctgtccaattaagaacaacttccaaagcattcttttcttgtcaagtcatcaaaacaatattttcaaagtctcaatagatcacatgcatcttatagtgtactcactgtttcatcattcaaatcatcgatgattaattcaattatgagataactttatttccataactttggctttttcaaactaggttgacatggcagttgcctttaagtggctctaacaccgaagattttattaatatataagatcaaggagacacacaagtgcaaaaatcggccaattgccacaaaagagctagagtgaaaagctgtgcttcagcttaatatctgatctttagccaatattattttcttacttgggggtatttttttatgggcatagtgttgataaacaccatttttagtaagaatatagttttatttaaaccttcttcaagaagccatggggcttcaacaacattataacctcaaacttgtctcctagaaataagcaatatgacagcagtcagcaaatgttatactacacagaattaatcttcaggtatgtgccatctgtgtgtgcctgcctgttgttatttgtgggttgttatttcctccatctcactgataactatttctgtgtctgaacttctactgtacgtattggaggtaggcgggagaatctcttaaaatcaactcttctttttgttttccaaatgcaaatatgcctgggaggatttttacttgaagtaatttataataaattatgaacaacttgttagtattgctgtcctcgccaagagagagactgagtgtgaaagggaaagacaacccctgccaccggaaagaacggagaaagggtaatcaaaatgcttacttctcagttctgttcaggatctgagctaacaaggcacacccaaaccagcatacggcgtgagatattttcacaaggcaattcatccaagtaagatgacagcaacatccctgctgctgctgctggaactacagtagcattaaatatttactgagcactaattatgttccagaaaatacactgcttcattgtctaatgtaaatcttacagctccccacaatagattctcttattaccccatttgaaagatgaggatatggagatttagaggcaataaataactttctccaccacatataagaaatgcatggcaaaactaggaaatgacttggtactttgaatgaataactatatcactctgcgggaagccaaggcctcctctccctaggggctgtgtatcctgtttaggagatttgagttgagcacctgagatgttatgggaaaatttataaggtttaagttaacaggagttgatctgtcttcaaatcagaacataccccaaatttgagaaggaggttggctcctaggatggacagccctctgctcttctaaaaaattccaaagtactcataaaccccttgattcaatccagagctcatagaacttgctctgtctctggccctcttccaagaagctgtgatttcctggttctgcagatctggcttcatttggaaacaggcagcatagttctctggaacagccacttctgagcatgctttcagaacagagcacattttgcgcttctcccagacactcatacagcataagccccctgtttacatctggatggtgttttcctacaaagagtaaaatgaagagctgaagcaattttctgaaacagctcaggcaaaatcttcagattaatgatattgatgtcttacaatattcttattacccaagtactgtaattgtccaactccagactcttcttcatcttgacaaaaattttaaattgtgtccattgagagagtatctaccattgcaaacaactgtaaacaactcagcagcaagatggctctgaaaagatatgccagggcccagatccagaagcaaaactggttggaggcctgaaaaaaagcatcctcagtttcaataggctgcagtcatatattctttctgtatttctctgaaggagaatttttattgccaaatgcaagctgtgaacagaaaattcatacctttcttttaatctgagctctccatcatctaagagcaatacccatccagggattcttgcagggcaggatggaaaaggagtgaaaagctacaatgcttaattcaaggtctacgctcttccctctgaatgaaccctgtacttcttctcacaagtgtgctgtgaagaataagtaatgaatgatcataaaccacccagacaacttagagtgcagtaccagtgatggaccctatttttttcccatgacttttctttcattttgtacagagcacagagagtctgggtgttatgtctgtgctctgttatatgatccctgcggctttttgcaagtaacaaatagccctccccagctaatactcatattgagccacacatgcttgtattctgtagagactgtttttatagatgaggttactgcatgtgattctaccttctatggtaataacctggcagcttttgaatatgtttagaacaagctaataagaaataggtccccaaaacatgtttctgctccatagaaacagccatggagcacaagggaaacctgtaagagttttgaatgaggtgtctgtcactgtcagagtcaaggctgaggtttctccagaatctatttggaggaaaatagaatgctgcttggggctgactaccttgttaaacaacaaaagagtctcaggacattatataaacataaatttactcaatcttttgtgtagggaagcatagggagcagaaaataagtcacataagccattttctagggatctacgtaaacaaccatctatgtaacctcagggttacaactttcatggtggaaagagaaagtaatagtgtcccttttctgaatagcgcaatattaacagcagcaccaaaaaacagataaaacagttctttgtttcagcttttggatgtgtattttaaattgaataaaggccacagatgagatgaggatcccaggatccctcctcttgtgttaactcacctaagccatgaaactcatcctagttctgttagctatggtgatttcatttaaatctatgccgtcacttctggtttgagcttggacatgtaaagaacttgagagtcaacatcctccttctgcaataagcaaaatacgaacaaactggaaatcaacacctttttttggatgcatcagagtaccacaattgcaaaacaaactgtcaccccaaaatcaggagagatagggttgtccagagagacacagctgagatttgctttctggagcaaaagctagagctataaactggtaggaactttaaaatggaaagtttgatgaattgctggaagctgaatgtttactagtattaagagtgagaaattcctgggagctgcatcttaagggggactcataccttcatggctttcctagatgtgtctaggaacctctgccagattctcacagtgaggatccaagaaagatgctctatgactttggaaggaataggggaagagtaatcattgtgaaatatgccgagaggcttccacataatgaaatttactcagcaggggaatagaaggagacacacttgtgaaagtcagagcccaagttactggtccactaaaacactgatatctaattggaacgacatagaatgtgcccccttacctacactatgttaccacactaacagggctctggtatcataacagcagattatgtttgagttgcaagacacagactctctctgagacggagtactgggggaagcccaaagtcaagagagaagaaaaactcaaacaaggacgttagaggaatttgaagctgctggcatctataggtacagcaaacgttgcacacaactgatattctggccagattaacataaatcctcacactatagggctatttaattcagttcctaataaccaataagtgttcaggtttcaacaagaaattataaggcattccaaaatgcaaaacaaacaaacaaaaacaagccaaaaaactacacagtctgaagagacaaaggaagcatcagaactaaacttagatatgacatagatgttggaattatcaaacaaggaatttaaaataatgaagattaagaagttaagagctctaatggaaaagtagacaacatacctacaagagcataaagtaatataaaaagaaggatgaaaattctgagaaataatgaaaaggaaatagaaacggtactaataatcaaaactagaaatcagaaacagtataacagaaatgaataatgccatccatcgggtgaagaaagaatcacagtgacagcatggaagatatgtcagtagaaactccccaaactgaaatgcaaagaggaaaaacaattctttaacaacaagcaaaatagaatatccaagaactgtgggacaactgcaaaaggtatatcacatgtataattagaataccagaaggaaaataaaaggacaatggagaagaaaaaatatttgaagtgataatggctgagaacttttcaaaactaatgacagccctgatgcagtggctcacacctgcaatcccaacactttgggaggctgaggcaggcggatcacctgaggataggggtttgagaccagcctggccaacgtggtgaaaccctgtctcttctaaaaatacaaaaatgagttgagcgtggtggcagttgcctgtgatcccagctacttgggaggctgaggcaggagaatcgcttgaaccctgaaggcggaggttgcagtgagctgagatcgtaccactgcactctagcctgggcaacagagtgagactctgtctcaaaaaaaaaaaaatgacaaatacaaaactacatatccagaaagcttagaggacaccaggcagtgtaaagcataaacaacccactccccacaaccaaaaaaaaacaaaaaacaaaaaacaaaaaaacttttaaacaaaccatagctaggcatatcatatttaaattaagttaaagacaaagaataaatcttgatttattcttctttcaagattataaggcattccaaaatgcaaaacaaacaaataaaaagaaaccaaggcagggactggggagaactttgcctacagaggaacaagaataagaattacagtggactgcttgtcagaaaccatgcaaataagaggagagtgaaatgaaatactcaaagtatgtgttataggctgaatgtttgtgtgttccccacattcatacgttgaagccctaatccctattgcagctgtatttggacatgggcctcttaaggaagtaaagttaaatgaggtcataagtgtggggccctgacctggtaggagtagtgtccttataagaaataccagagttctctctctctctccacttgcacgcactaaggaaaggccatgtgaggacatattgaggtggttatctgcaatccaggaggacagccctcactagaaaccaaatgagctggagccaagttgtcttggacttccagcctctggaactataagaaaataaatttctgttgcttaagacaccaagtctatggtagttcgttatggcagcccaagcagcaatatagtgttgaaagaaagaaacaccaatccagaattctatatacagtgaaattatccatcaaaagtgaagaagaaagacttcatcagataaacaaaaacggagataatttaccaaaagtcctgtcctgcaggcaatgttaaagtaagttttttgggtagaagaaaaatgatataggtaagaaacttgaactatgtaaaaacaaggaatagcattggagaagaaatcaatgaaggcaaaataaaatattgtatttttattattttaaattaatctaaaagacaagtatgtattgaaagtaataataacaataatataccgggtgattacaggatatggataagtgaattaatggcagcaatggcacaagagggagggattggaaatatcctatttatatgtgcctgcattacatgtgaaacagtacagtgttatttgatggtgagcttctattaagttaaaatgtatattgtaaatttggggcaaccatcaaaaaattcttaaatgtagttgatatactaagaaaggagataaaataagattatgtaaaatgctcatttgaaacagagtaggcagaaaaatgagagcactaggaagggaataaaaaacaaattcaataaatagaaaacagacacatagtagatgataacccaaccacataaacaatgaatttaaattggaatgttctgcaaacactaattaaaaagagattgttacagtggacataaaaacaagttccaactatatgttgtgtacaagacacccgcattatgtataaagactcaggctgaaagaaaataaatggaaaaagatatgccaacctaatatcgatcaaaagaaagttggagcagctaaattaatttcagacaaggcagctttgaaaacaggaatggttatcaggggcaaagatgagcattattataattgtaaagggggcaattcttcaaaaacatcatgacaatttaagatgtatatgcacctacaaagagaataccaaaatacatggggcaaaaactgaataactgtaaagagaaacaaataaatccactatcatagttggagatttcaacatttctccattggtaagtgatacactaagcagacagaaagtcataagattctaaatgatctgaacagcaccatcaatcaacttggtctaattgatattttatagcataatccatccaacaacagcagatgcttctcaagttcacatggagcattcaccaagataaaccacatcctcaagcataaaacatacctgaataaatttaaaagaatagaatttatacaaaatgtgtcctgagaccacaagagaatcagactcgaaatcaataacagaacgttatatctgaaaattaaacaatacacttttaaataaaccatgggtcaaagaagaggtctcactgaaaattttaaaatatttttaattaaatgaaaaggaaaatacaacttatgaaaacacatgggacacagaggaagtagttcttagaggggcatttatggcactaaatgtacatattcaaaaacaagaatcatcaaaattctgtatactaaagttctgctatggaaaactgagcaaaaaagagcaacttaaatttaaagcaagcagaataaaagaaataataaaaattaaaataaaaatcaataaaagtaaaaacacaaaagaaaaaatcaatggaatttaaaaactggctctttgaaaagatcaataaaattgacaaacttctagccaggctaaccattaaaaaagaaaaacaagaagacacaagttgcaacattagacatgaacataagttcatcactattgatccattggatatctacaggataataaaagaatactataaacagacagctctatgaccactgtgataatttagattaaacagcaatttcttgaaggacacaaactttcaaaatgcacagaaatagataaccagcatagccctatgtctatttaataattcaaatcaataattaatacctttctaacgaagaaagctagacttagatgtgttaactggtgaattctaacaaacatttaaggtagaaattataccaattctccacaatctcttctaggaaacagaagcagagggaacacttctgaaatatcctaggaatctagtatcactccaatatcaaaagcatttcaagagagataaaatatacatgaatatatttcatgaagaaaaatgcaaaaatcttcaagaaaatattaccaaatgtaatacaacaatgtataaaaaattatacatcaacattaagttggatttattccaagtatgcaaagctgattcaacattaaaaagtcagtcaatgtaacccactgtatcaataggctaaagaagaaaggttatatcatcatatcaactgatgctaaaaagccattcagcaaaatggaacatagtcatttaaaaagctatcagaaaactaagaatagagagaaacttcctccacttaatcaaaaacatatacaaaatagctacagataacatcatacttaatggtgagagactggacactttcctctaagactggaaacaaggcaaggatctcccctcaacactcctatttaatgtcatactggaagtcctagctagttcaatgagacacgcaaaagaaataaaatgtatacaaattaggaaggaagaaatagaatggtctttatttgcagatgatacaatcatctatgtagaaaaactgaaagaataaacaaaaagctaacagaactaataagtgagcatagcaagtttgcaggatgaaaggttaagatagagttaattgttgtcttatgtattagtagctaacaattggaatttgaaatttaaaaagatactatttacagtggtacacccacaaaaataaatacttggtataaatttaacaacacgtttattgacttgtatgcaaaatactataaaattctgatttaaaaaaatcaaagaaggtatagatagagagatcttccatgttcccggattggaagactcaatgttattaagatggcaattatttccaactttatctatagattcaacataattctactcaaaattccagcaagaaattttacacatattgacaaactgattctaaagtttacgtgacaaaaaaacttagaatagctaaaacaatagtaaagaagaacatggaggaatcacaacgcctaactttaagactttctaaaagctagaaatcaagataacatagtatcggaaaaagaatagacacacagatcaataaaacagaaaaagacttacacaaatgtagtcaattgctctttgacaaatatgcaaaggtaattcaatggagaaaagacagtcttttcaacaattagtgtgggaacaattggatgtctctctataaaaaataaaaatagacacaaatcttacacatttcccaaaagttatctcaaaatgtttgtagacctaaattaaaaggcaaaactacaaatcttttagaagaaggcatgaaagaaaatctacatgaccttagggttggtggttaatctttagatacagcaccaaaagcacaatgcatggaagaaaaattgattcgtacattttattaaattaaaaagctctgctgtgcaagataccttgttaagagaatgaaaagacaagccacaggctgggagacaacattttgaaaacacatatgagatagtttggatgctgtccactctaaatctcatgttgaattgtagtccccaatgttgtggggatgtgagaggtctttgggtcacctcagggggcatatccctcatggcttggtggtgtcctcacagtggtaagtgagttcttgcaagatctggttacttaaaagtatgtatcactttactatctctctcttgctcctggttaccatgtgagatgcctgctcccccttcaccttctactatgagtgtaagcttcctgaggcttccctagaagccatccatgttatacctagaagcctcaggaagcagttgccagcaccatacttcctgtaaatcttgcagaagtatgagccaattaaatctctcttctttataaattactcagtctcagttatttctttatagcaatgcaagaatgatttaacacagaaaattggtatcaggagtgaggtattcctataaagagacctgaaaatgtagaacggagtaacaggcagaggttggaagagtgtggagtgctcagaggaagacaggaagataagggaaggtttggaacttcttaaagactgggtaaatgattgtgaccaaaatgctgatagtaatatggacagcaaaggccaggctgatgaggtctcagataaaaatgaggaatttattgggaactagagcaaagaccacccatgttatgccttagcaaagggcttgactgcattctgttcatgccctagggaactgaggaagtttgaacttaagagtgatgacttggggtatctgacagaagatatttctaagtgtttaagagttgtcctggctgcctctaaaaacctattctcagatgtgggagcaaataaatgacttaaatttggaagttatatttaaacaggaagcagagtgtaaaagtttggaaaattttacaccctaaacatgtggcaaaaaaaagggcttttttgaggggatgaattgctgcggagcttattagagaggtttgcatgactaaaaagagccaagtgctgatagccaagaccaatgggaaaaagtcctcgaaggactttcagagacatctgaagcagcccctcccatcacaggcccaaaggcctaggaggaaagaagggttttgttgaccaggcccaggattctgcagccctgagcagccttgggcactgcttcctgcattcaggccaatccagctttagccatggctcaaagggacccagttatagcttaggccacagctctggagggcacaagccataagcctgtgtggtttccacatggtgtcaagcctgcaggctcacaaagtgcaagagtgaagaagctctggaagcctctgcctagatttcacagaatttatgggaaagcctgggtgtccaggcagaagtctgttgtaggggtggagctctcacacagagcctctactatggcagtgcagatgggaaatgtggagttggggacccatgcagagtccccactggggcactgtctagtaaagctgtgggaagggggccactgtcctccaaatcccagaatggtagagccaccagcaacttgcaacctcagcatgaaaaagccacaggggtagggtttcccagggctttgggagtccatcccttgcagcagtgttccctagatgtggtacatagagtcaaaggaggttattttggagcttcaggatttaatgactgccctgctgggttttagacttgtgtgggcctatagctactttcttttggtgtatttctccttttttggaataggaatgtttaccaattcttgtacccctcttgtatcttggaagtaaaaagcttatttttgattttgcaggcttgtaggtggaagagacttggtttgtctcagatgagactttgcacttaggacttttgagtaatgctgaaatgagttgagacttttggaggactattggcaggagatgattgtattttgcaatgtgagaagaacatgagatgtgtgaggccaggagcaggataatgagtttggattgtaatcctcaatgttggaggtggggcctggtgagaggtgtttgggtcatgaaggtggattccttatggcttggtggtctcctcactatagtgagttctcctgagatctgattatttaaaagtgtttggcaccttcgtccccgacttgctcctgttcttaccatgtgaaacatctggtccccctttgccttctgccatgtttgtaagcttcctgaggcctccccagaagctgagcagataccaggaccatgctttttataaaagcatgcagaaccatgagccaattaattttcttttataagttactcagtctcaggtatttctttatagcaatgcaagaatggcctaacacaacatatttaacaaagggcttgtatctgtaatatacaagaactcttaaaactcagcaataagaaaataaacaagccaatgaaaaaatgggcaaaagatctaaacagacaactgagaaagaaagatataaagatggcaaagaagcatatgaaaagatgctaaatataatttgccatcacagaagtacaaattaaaacaataataagataccactacattcctattagagtgattaaaatccaaaaaactgacaacatcaattgccagcaaggattcagagcaacaggaaatttcacctattgttgcagtggatgcaaaatggtatagtcattttggaagaggttttacagtttcttgcaaagctaaaataggcttaccatatgttccaagactcatgctcctaggtgtttacccaactgatatgaaagcccatgtccacacaaaaaccagcgtgtgaatgtttacaactgccttatttaaaatcaacatcaactgaaagcaaccaagatgtccttcaataggtaaatggataaattgtgatacattcagacaatgggatgtcattcagaaaaaatgaatgtgctatcaagccactagactaggttgtagagaaccgtgcatgaggtagaatctgacactttggagctgggctgtccactgggagagtgactagccacatgaacacttaaaatatagctagtgtgattgaagtactgaattttcaatttaacttaatttaaaattaaatacgcaccatgtgtctagtggctgctatctcagcaagtccagctttaaaacattaaattctgttcctctctcctgcaaatgtctccaaccccagatctagtgccctttgcttctctctccattctttgttataaggatcaatttagactttctctcttagtttttatttgatgctctgttatggtggaaggtgtggatatgagctaggaagagtggggataagtagacaagtctactgaataaagacagcaccctctttttgtagagtttcagacactgttctaaggaatctgcatgggttcctttatctaattgtcataaaatcctattataatgatttccattttatagatgtggtacctggcacacagagaggttggcaaggttcacatagctacgaaacagtggaatcaagccaggttcacattgtataccactgtgctatagtgtctcctagtatggccctaatttgtggggccaatgggcttgaaatagcattcacttacttccaatactacagagtacagaagcagcagcttctggaatttaggtatcatgaatgattagtaccttgtcctactccagggagtaggacatagaacattgtagggctgatataggctggggaagagatggcatccatctgctaccaatatttgcattgatcatgtcatttttaggtccagtgtcttcagtggcttcccagttgtctaggcatcaaatgcaaactcctcagcctgcaatttgtatctaacttacctttgtgacttgatcttcaactccttgggtgtttatagcctctacatggtttctactacccactggtctctgagcccttcttgcaccagtcttcttgacttcctaatttgtgattgaggcatctttcccagtgggatctaggtggtctagctcttcactcatgcttctcaacctttcatctgccttgaagcctgtgtagaatacaccaacccagtaacatgaagcccagtgattgcctcccttccattccactgccactgcccttgcttatgtccacactacctaaaccactgtggtctcccagctcctccttcctgtaatccacctccaaaatgcacccaatagctgctgagttggtcttcctagcaatgctcagcaactcaaattcttgctcatttgcttaaaactttcaccctttccccaccacatgataataataaaggtttcctacctctcttaatcactggccttcttgcgttttcccaagcatgctggtatgtatttaccccttaagctttgcatgcactagtccctctccctgggatgcccaagtggttggttcccacgtagcagtcaggactatgctcaagtttcattctctcagagaagccttccatgaacagaatactggatctagctctccctttcttctcttttcccctcttctttatttttctttgaagcatttatcattgcttcacattatacggcaggtccttgaagtataccattttgttcaatgtttcattacaatgttgatgagaaaagtaattgattctgtgaagtctgcatgttctcccaatgtctgtgtgagttttctatgggtcttccggtttcctcccacatcccaaggctgtgcatgtcaggttaatgggtgtgtctaaatggtccccatctgaatatgtgtgggtgtgttagtgcaccctacagtgggctggtgtcctgtctggggctggttcgtgccttgagccactgggacagactccagccacctgagatcctgaactggaaaaactggataaatcattatcttacttgttttgagtaatcttttaaaaatgtgaagtttttaaaactttaattcacattaatttcaatgtttaatattaaaaggctttcgggtctttctttagaagtctggcaattttgtgactagaaatatgccaaaggaacttaactcctgttgctataggttagcctaggtaaaactggtttcattgtatgtaattgcacttaaagttacagtttccaagaatctatcaaggatattaagtgaagacttactgaatattttttgttttgtttttttgttagtctccctactggaatgtaattctgccaaggcccacatgctgtctgttttatttactgctatctacagcaccgagaaccatgcctaggcccccaataaacatttgttaaacagatgagaaaatgtaaaatataaatcagaatagctctattaatcagacaacctggttataagaaacagaaatctaggaggacagtgcttattaataacatttggaaggggaatggcctatcagtattgtttctctaaagttgtatggaccaaactgtcttatcaatttgcagtggcaggctcattcggacaaaaaaagattaatactaaatgctgcattccatgttcatttcgtgaagatccacaacacacggtagcatctttaaggttctgagccaccctgtaataaacaaactagacttaaaaaaaacttaaatatatatcagcacagaattctttttctaaagagctcctcagagtagattcaagttaaggtggtggcctgacgtgaaataattctatcccaccttcttctgatataggcatggtatatcctagcacagaggtatgcctctgtggctcacaatttgtctaacagatggacatgtgaactaagccaggccaattagaggacatctgagaattaaatgatgaatctgagagacagactttccttgcctcgcaggctgtggatctaaggctataacttttcccccccataagttattggggtacaggtagtatttggttacataagttctttagtggtgatttgtaagattttggtgcacccgtcactcatgtatacactgcaccatatttgtagttttttattccccaaccccatctcactcttccccccaagtccccaaagtccactgtatcgttcttatataaggctgtgacttttaagaagcccaatctatactccttgtctcatggagaaagtctgtttatggcaggacaggagccaacataattctcaacaagagaattagctgagagatggagagaaaaagaggaggaaaaagtaaataatggagaataatagggacttaatagggataataatatggcatttaagtctttaaatccagtcaatttctgaagcgagatccacccctgtcttgacgtttgaaaatttcttttttttttttaaagatcggctcactaatacacactcaataccatttttacataatgcccaatgacaaacctcagcagttaagcctgacttgttgactagcccactcaaaattgtaaaggacaacacataaccaaccaactaaccaaccaacaagagcaaatggtgcccttgtctctgaatgatatacagatttttttctactccttcatggatgaaatctacatagattcttagcttccaacaagagtaagataatcagatacagtgtgatattgtgcaaagaccaaggtgagcacttacaagtttaaagtacacaattccaagggctgggggtaggtgctattcacagcagtctttagaggctctttagtctgatgaacctgactatgcaagttctctacacctgtgtttctgcagaagcaacaaggggcaatcttcctccacccaggaaagcaagacacttgcctaatgcttctttatgtcctccaacagtgtcttacctagagaagggccttaattcaggtttgtggaatgaatgaaactcaggctggtcctgttccttattaacatggttatagtcaaggttggcttaaggaatttgtaataaaatttattttcagcacattacttcatgaatgctatccttgtagattcatatatattcagtggttgcttttgagaaatctaaaaataccgtcacttggcatttgccctagaacagtgtgctgccttgatgcagccataacagtcataccatatgggaggaaacctgggtactttcaaacagactcctcttttaaaatcaagtctgctgctgtcgctggagcttgcagcctcctgaacctctttatttagatacagcattccagggccattatttcatatgtagagggatttttttaaatagcttgcagtttgggcttttcaccactagagttcaaccttgctcttatctagatgatttcaaggaagaaaactaactaaataaaataaatcagcatctcctcaaacaaaacacaaagaaaattccctaagtaccttctctaattccaatcctgacctttgactaccaaaagctggcttcgttcatgtgccttttttttttctgacatacttaagatttcctggttggtattgtcatcagggatcaaattcttgaatgcccttgcttagttacaagtaatttatcaatgcttgataaataatttctccttagattcagtttgtttatttctaagtacaatctttagccgaaactgcctggctgattgatgggagagcatgcttctggtcggtagatcctgggggctcacaacagggtagtcagagctacagtgaaagcgactgctactctgggtctcatagttgatcattaattttttgagaagttttttctttaataaatatagctttctccctgaggtttggttttgatttccaaattcaagacgtacctcttttttccctttctttgtacccattgtcttcagatatatttctgaagagaccaaaatcaagcatacaatgtcacaattttgctagtggtcaacctatcactcccaggacttctaaaaactatgctgtgtcaaattaggcatacataataattagaaatgcatgataaaagctaacattgcacatttatcatacacttggcactttagatgctttatttcatgcaatcttcacaaaagtcttatgaatcagggatgatcctcagtcccattttacagataaataaacagtaatatatataagtctttttttttgagataaggtgttcactctgttgcccaggctggagtacagtggtgcgatctcagctcactgcagtctccgcctcctgggttcaagtgattctcacgcctcagcctcccgcatagctgggaccataggcatgagccaccatgcctgactaattttttgtatttttggtagcgacagggtttacgccatgttgtcctggctggtcttgaactcctgagctcaagcattccactcgccatggcctcccaaagtactgcatataaataatttgactaaggccactcagctagtaagtggtggagtgagaagtcaaacacaggtctctacctgaacattgtgctcaatgagggttctacattcatatagcctgaactttttgagggcacagataaagagtataataataaccctgataaaaggagtggccatggctaggcagaaaagcaagaaacttgcaagggatacgcagaaattaaatgatgaaacaaaatgtgttaattgagattttgcagcagacacagacaccctgttcaaatggctgacgtatataggcttcaccatctctaataacagagaacatgctatcaacatgtaatgtggtaagaacttctctcagtcatactggctaaaatgttcaccaatttattacaaaggagaatcttaaaattgatcttcaaaactcactatttagattttcacagttgtgacaaataataatgctcaggttggctgtatgaggaattatctagggttcaagtagtctcatctaacctttttgttatcactttaacattctgggttaatgagtcctgtgtcctaccaaatgctattacaagtacttacccctgataggccattcattgaactgtttacttattcattaaatactaagcgtctactacataccatgcactgtactaggtgctgagaatatgaaagaaaacaaaacaaaaaacaaatgaaaatctctgtctacattttacattctggtaggggagatagaaaatgagcaaacgaataagtaaaatgtgtagtatgtgtgatggtgataaatattacatagagaaaaataaaactgggaagggagataataaatgctgttcgattttgtttgcttgtcttgcaacttgaaacagggtggccagagaaggataacaacagtaataataataacagtaatagtagttcttcttcttttttttgtgagacagggtttcagtctgttgcccaggctggagtgtagtgacccaatctctgctcactgcaacctctgcctctcaggttcaagagattctcccacctcagcctcctgagtagctgagactacaggtgcacaccatcatgcctggataatttttgcattttttggtagagacagggtttcaccatgttggtcatgctggtcttgaactcgtaacctcaagtgatctgcccacctcagcatcccaaagtgatgggattacaggcgtgagccactgcacccagcctaatagtagctcttgtttttggtcattctaggcaaagtagcagctaacattaattgagtacttactatgtagcaggcctctttaatttatatctcatttaattttcataaccactctgtttcacagataaggggaaacaaacacaaaaatcatgtaacttgtccaaatcacacagctaacaaaagaaaactgtggacattttgagtcagagcccaggttcttaaccctaccagcatgcttttcttttggtatttgctgctgtatactttaattgcctatgtaagaaacaacaccgagtgaaccatgctgacctaattttctagttctagtttgtttcattcatagtaatataaaaattagctgcttattttccataataactccttaaatacacttgttatgtggaatatattaagttagttaagaatatggtttatttatatatctagaatatgtactccctttatattaaaatatttatagcagctgacaaaatttagtgcaaaatagactgattatccataagaattataaatgataaataaatgaaccttggtaggttgtgcatgcaaagacaaatcagttaatgataaaaacagaataaggattatctgcaggagcatggggtgcaggtaatatcaggcatctgagatgaactcactactactatcagaaactgagtttggctatacgtttcctagctgctaagacagagcaacatccacactaggttacataatattcatttttttgaacaaaagaagatagaaaattgtccttgagaaaaactttcttacaactgatccttgtaaaaggttcatgggctaacagtgaagaatattttcaactttgcaggaagcaaggactcctgaaagaatttttttttacaatcttctataataaatgggagtgaaaatgaaattggcatttttggaagggggggggagaaacagttgagataatatgacctaggtattctctgttctgcataccttatttaacagtgggttacagaatggggaaatggatagttaacaatttccacggattcttcctcaaaatattaattacagtaagcagacctttgacaggtgtcatatcacaattaatttcatgactagtaaaaatataattagactagtaaaaacaacaactgctacaaaataacagtggcagctaataactactgcatacttatcaggaggcaagatctgggtcgaacattttacaaacattatttcatttaaggtttcccataagtttctgagttaggcacagtcatgttcccattttaaagatgagaaagctgagacttagagaagttaggaaagtttcccaaagttgcccagctagtaaggatccgagagctcagattcaactatggtcggactggttccaaagcttgtgtttttatctactactttgtggttactctaccacctttattatatctattccatgtttttactgagacaattgcacaagacctgaggagacataaacatttaagatgagaatacacagaggaaaaaaagaagtgttctccacttcctagacaaaattagtaagtttaagaagacacagaaccatacagcttacatgaaatcagttctactatttatcacgatggacaaaagaaatgatgagccactctgcgcactgtcataggtcagactaggatctcgcctggaacccgaggatgtgagaaaccgctgtgactcatggctaactgctgtttcagaacctaggacagcggcacacatcccttccactagggggcagggtggtcattacattgtgattgtttataagctgagcctgattctgacaggcagaaagccagctcaacttctgtagcttcagaataggcagccagtggggccaagtgtccatgtttgccccagataagaatcttggaccttttcaagtatttgtaaaagcatccagtggacaccttagctttttgcatttggtaaccacagtgtcaagagctagaaaaagtgtaaaataccaaatattagaagagctttggacagtgccagcttgaaaatgcctctcttggccactgtacttatgttgattgatttcatatttacctgtggactgactgcaataaatgggcttgctagcacatttttggaactatccttacctaggctatgaaaagttcagaaagggaagttaagggagaacagtataacagaagtggctagtaacaggggctttggagccagatagacatgaatttagacttgatttcaccactttttcacaataggactttgagtaaatgataacctctctttctgtacttcgattttctcaactataaaatagaaatggtataacagatatcttacaggattgttatgatgactaaatgaatctctaaagcacttggctggatgtctggcacacaaggctcaatgatcaccaggatgatgatgaatctgctattgaaggaaaaaaataataaccttagcatatgtcaatttacgttacccaatatagtttatacatctcaaacaaatataagaaatgtatataaatattcactggttcatttactcatttatttattcatcaagcatttattaaacatctgtagtttgccaggtaaggggaatacaaagacaatcattaagaaagctcacaaatattctagcatatagtaagaattgctttacccaatgaaacagagcaatgacatacattgttgccacgtaggaggatcaaaagccactctatactttgccatttgatatggtttgggtgggctgtgtccccaaatctcctctcaaactgtaatccccacttgttgatggagggacctgctgggaagtgactggaccatgggagtggttcccccatactgttcttgtgatggtgagttatcatgaaatctgattgtttaaaaatggcactttcccctttgttctttctgactcctgctgccttgtgaagaaggtacttgcttctctttcaccttctgccataattataagtttcctaaggcctcctaagccatgtggaattgtgagtcaattaaacctcttcactttataaattacccagtctcaggtatttcttatagcagtgtgaaaatgggctaatacactatactttccttctcccccctaaaacaatgcacgatgttacagatagcaacttctcggccagtctgggtctctgaatgagaatgatggcaatgtgcaggagagaccccagctgacttttgatggcaataaaatgtgcacaagaaatcaactgtttattataagtcatttagatttggggtcatttactacctcagcacaacctgggatatcctaaatgatgttaggctgctgctctcaaaacaatctacaatggtggaatcgatgcatggatgcaaacaggtaaacaatcatgcaaactgcagcataaatgctataagagatgtgggagtgaagtgctttttggcaggaatcaaagtaataaatttgtgatgaacttgaaaaggtcaatatgcacctatctgctaacaaaatatctggtgaggctacaatgtggaactccatttcaagcagaggaagacaccatctgagggagacacagcaatgccacagaacgtggaaaatgtaagacttggggaagggggatggtttataatcccactgtaacttggaaggaacattgagaaatagaaaatagagtgacattatattctaatgacccagtgacaataacagtcttactagtgtgccagctcaggtcatatattgtgtaatatatggcttcatttccacttttgaccaatagctacacacaagaggtggtaaaaccccgtataatttggtcaaaacaatattgggctggaaatcagaacctctggctgctaatatggggtatatcaatcatgagaggaaatctgaacatatttttttctctagacctccattaccttattgataaaatgaatggaaaaaacctagattatttctgatccattctatctctaagattgtgtttcctacacttgaaatgtaacatttgaaatcttcattgtttgcgtgaaaagattccacctgggaaataaaaccaggctattgacttgttataaatggagagctatttgattgcatcataaactgtaatagatcctgtggaagtggggaagctactcctgtctccttggaattagtgcaccctcaaattccaatggcctgagggctttctctggtggccagaggctccttggccccattgaataggttggaaatccagagaataattcctcttggaagcagccatgaacaatgactattgtaagttggtagacaaatgtccaagttctctactctacaggtaggataattctgaagttggacatcctcaggattccccagcaggactgagtttccattactcacatgacaactggtttgacaatgtacattttactggctacctcccctttcctgtgtcactactcattcatctactgggattttctagattcacctctgaaataaaacatctgcactcgaattcttgtctcaagacctgcttctagagaaccctaagacatatactaatacacaggtgaaaatacaactacactccactgtcaataatttttaggattggtttaaatgtacttcctacacttgggtgcaagtaaaatcacattttcaattaattaaatctggctttgggctgggcgcagtggctcatgcctgtaatcccagcactttgggaggccaaggcaggcagatcacctgaggccaggagatcgagaccagcctggaaattatggggaaaccctgtctctactaaaaatacaaaaattagctgggcatggtggcacacaactgtaatctcagctacttgggatgctgaggtaggagaattgcttgaacccgggaggtggaggttgcagtgagccgagatcatggcactacactgcagcctgggtgacagagcaagactccatctcaaaaaaaaaaaatctggctttgaaccctaacctcaatgctcattgttcagactctcataatgattcaaaggtgaacaactctactccctctatgccaaactggggcatggagatttttgcagttgttcacaaatatgtaaaatctaatgtgcagtctctaccatagatgtgttgcctcactgtggccctatgacctccttgacatgctggaaacccattatttccttcttctatggaaagccccattttggtttaaggcactccaccttgtcctcctctaacttccagtgctggtagccatcttctctgactttgaaggtctgaaacatgaaaacgaaatctttcatgtctgaatgtgtgagtttgggttgcgtgtgtgtgtgtgtgtgtgtgtgtgtgagagagagagagagagagagagagacagacagacagagagagagagagagagaatgtgtcagagaaaaacaaaacagaaaggataacttaattttctcctgaaaacccaacaatgttctctctttctgaatagggaaaataaaatgctttattccccactacaattccccaaaagaaatgaaactagtgttgagatgtgtgcagctgttattgctgttaaaataactcatcctatatcaccttgtgaaagtttgaacttcatgtgcctaggaactggcagggatagataaaaaggaaaaggcaaacaggcattttctccttttaagatagaagacttttaaatattacttttgcataagaggggctcaaatcttcatcttcaagatgtggcactcccttaggtatttaagttgtgcataggttgtctatttctctatatactagtcttggaagagattaccacttatatagtggcagaggtaaaatcggtcaggtacttttagtggccagaccactctctgagaataattttcttagtagatgtaactaggatttgagactagccctagtaaatgatatggccattttaataagcaagctggataccaattctcttcagatgtatgaaaagaaaccctcttggggcaaaaaaagagttctaatatggagagatttcattttcaatgacgtaacctcttttctctttgcactgtcatacatagcttccatgtagagtcaaaatgttaaatatttgaaaaagggagaatttatatacctgaacaagggtagtcagttctgttaatgagagcaggctgctaatgatgtcagagtcacaactttgatctgtatctgatttattaatttccagtttatctatacctttattttctcctatcaaccccctgccgaccatctgcctaacgctttcaaaggggtgactagttatttgtctggctatcaatccaaatatcaccacaaaaaaatcaaaacaaaacccttaaaacaacctattctgctaaggatggaacaggaaataagtgagtagccacaatatttttcattggaaagatgaggttataagtgatttgcttactggtaaggcgaatcatgcaattccactgagttacttatgaacacaatctgatcctagttgtcatggcaacatacaaaaaaaagtggaaagagttcacgattacattttcttgaaatgatccaaaatattaactgtaagtatgtgaattctgtagaaaatgttatttaaactttttcttggaatctcggagctgctgctggattccaagagatgtctgcctgcagctgttcaaccattataatccccctctgtgatgaaagcagaaaagcaatgaagatttgaagaaaatagaagtcttgcttcaccctcaggacatctttctctaacacccccctccattaatatacaaggcgtgaaacattaaatgtcacatccatgtcatactctaatgccactgcactgtagaatcaaagtgtagaattcttttgccaatgcgacttgggataaaaagaaatcccactaaccagaataaaaggtcaaaaacataattcttagttttccttcacattttctaccaaatgaggacaaattggggagaaaaatcctaggcttttgagacatcattttctcagtgttctagtagaaaacagtgccctgaataagaaggtcacaaaaaccaccaaacactcctctatcatatgtgaataaaaacctatagcttcatccaaaaaaggaaatgcataaaaccttttaggaagagaggccactgttgtatcttcttttgaaatattttttattggtattgtttttcagaggagagatctgatattttctctcacaatcatgaacttaaaaatggtactatgaaaggaataattaaccactgatcattattttccttcccagcaaaacagaactcactctaccaatgaaggaccattagtatttaatgctggaactctcttgcacatgactctcatatctctacttcttgcattgatgagatttcaactgggtttagtgactaagagtttgtgtgagaatttgaacaaggctatttttcccattggtttacccaaaattgtctgcaactgtcagcatttctgtgtgcaggctgctaggtgggattaaatatatacgtccttccacttctcagcggatacaagttctcaggtcagccaggaacatttctattccaacatgatgactctgtaggctttagtgtaagcacacaagccacactagagttgtagggtgctgctctgttctcgtgggatatgtaaacactcagttgttcctaatgtgttataggaaacaggtattagggattagctttttctctaggctgctactctataattcaactagtttgttctcttctaccttccagtgtgaaaagaattcattattccaattttacaccagtgttttccatctttctgtgtgtgcagaacattttcaaaaacaaatgtttgagcagcacccctgaagtcaacagtaatttcaacctaaagcctattacaaaaggacaatattttgtagcttcagtaaatgggtccacaatgttgccttgctctcttggtcaccctcagaccctgtctttttaagtaagattgttgtgctgtttgattcaagaattgggtgctgggaatgcagtactggtgaataaacagacatagttgctgtcatcatgaaatgtatgtgatggagatggagacaggagctaagcagataattacatacaatatttagctgcattgtgatcagcttaaaggggagaaagacaaaacaaatgacaaatttaaatattgttacaagtaaacattttctctgtttcctctcctccttctctttctcctttaaaaagcttggggaaaagtgatcagtatattctgttcacattaccaatcagcaactgttaaataccctgacaacaccagatgttgattccaaaatgaatggcatctggtctagtacatgagaaacagcacacgcaagtgcaggcctgggctcttaaacgtgccctgagacatcttggaggatctaggggaattttaggatggtattagcaactggtactccaccagcctgggtcctctgggaatctgctgtggtttcaacatgctcccagagatactgctatctctcacagccttcatcaaaagcagggtgttcaccaaagccagccttgtacccttgtgaccatggcacactgctaattaagggtaaggaaacaaaacggaaataatatctgaagcccttgccactctgaggatatttgtgaatgtcagggagaagaaaaagcaactttcaagaaccagggggggcaataaaaagcactggatggagaatcaggggaggtatgttcttgttctggctgtgtctctaaaaggttgctctgaaatggtgggcagtccattccacctctctggctctcacccagaggtgaatgagttggctagattacctctaaaaaaagacagattaacgaagtgactaacaaaacagactttggagacagtgagatttggacttgcatcacttccctcccattttacaaggtcagaaacttaggagggttacttagcccctctaagcctcagtatcctcatttgtaaagtggagatgattatagaacatacctcaggattgttttaaggatagaattaaataaagcaaataaagtacttgtcacagtgcctagctaagtgctaagtattaactatttttttttgtttttttagaaaatttatgtaattccattgctttgtatgtaaattaaggcaaatgagtcgtcgtgtaatttttcatgtaaccatgtaatgatattgaaaaattctacttgccatttctttttatcagtttgcactcttgagatgtgtgtgtgtgtgtgtgtatcaatgtatgcatgggttgataaggacacttattcacttagtaagtatatacaacacagttttgatatgaaaataacactctgctagtgctattaccatgtagatacaagtacaatctaactttcgtttcttgaaacataattgggggtgggggtgggtaagaaacactcacaaaataagagtttaaagaaataatcaaatgccaaattagaggaaaaatggtgagtgctatgggatacaaacgaaaacactcacacctcactattaatttactggctttataagagaattaaattaggactttatctaaagagattaatcatagaagtattaaaaagggcctctattagacagcctggctggtaaaatagtcctctgatctataattaaaggaacactcctgtgtgtatataaagtataagcccttcttcattcagtatattgtatcacaaaaggatacaaaatgaaacattaaaacttgttacaaattacattatttgtcatcatttataaaatctatagtttggggactttggtcaaataagattgatctatttgtgttaccacttgattaataaaaataagtgtttccaagatgtgtgttggtctccatgcagcagagatgttttgctattgtttgaaaatactaaggtcgtattatttcctcctcaatcagtggttttggtaatgaaatttgattgattttatgacctttcctagtccctttataattttaatgataaaaaggtagcatctagatttgattgtaccataaattgcagcttggctcatggacatgtattgtggtgattaccttctcctgctatgtaccactgacaaacacagctcagggctgtccatcaatcaagtcaatggatactgaaaaaggcctgtggatcactccattctccaaacttagtgggtatcttaattctgatacaccttcccccgggctcccaatgtaaaataccttgggccactgcttcagtggaccttcatccctgataaggctgtttttttccaggaagtatgatggtcatatttgttttagatcccatcttagtaaaagatttcatctgccaccctgtggcagtgtaactacatcactagaaggggtaaaattgttaataaccttcatctgccaccccaaacacctcagaaataattttctttaaaatattacaattactgattattatctgaaacagatttttctctttaaatttattcatatcatctttcagtttagcctcctccaggataactacacagctgattcccatatgcaacaggaaagtcaggagctgagctctgcttgctgctgttcctgaagagtgactacttaccacttatgcctcatccattgtcagctgttcaccaatcactactgagtatattccaggcacagttttatgtcctatacatgggttattttgtttgatcctccaagggatgcatggggtgggtattttcttaacctctattattctaatgggtattattctctattattcggatgggtattaacctctattattctgatgggtaatgaggctcaaagaggtaagggacttgctcataggacctcatctaggaactgaaggcagtggcattaaaaaacccagaagtcctggcgctgaagcccatgctgttaatcactatagtgcatgtttgcttacctctacaaacactggccaaacactggatcattatcttgcattgaaataattttcctgttgcattagtttatacagtagtaaaatagagaaaagactctgggctcagactgcccagcttttaattattactcaactacattatccatatggccttgagtaagttatttaacctctttgaacttaatttgctcctattccaagatgggaaaaacaacaggatcttattctaagggtgggtgtttgggaagatgtaacatgataaaacaggcccacttagtataatgccatgtgctgagtgctcaataaagattactgagtattattattacggtataattatcaaatattattattcaataaaatagggatgtgacactctgttgtccaaagagacatcaagacatctaataacttagggctttctgggtgaaggttgtgaagaggaaacaggagagagggcaggtagtttcacatacacacaagaagaaaaaggcaaaatactgacgaacaggtgctagagtaagcagtttcagccaaacccatcacacagcttccagccccatggaattattatgatttccctttcctattaaggagtcacatctggatataaagttcaaaagcagactttgtcagaatgagcgtgcgcaagagctgcttccacagatatcctggctgctgttcacagtgctcgggttttatgtctcttgttttatcctgaattatttatcctgagcatctgtgttacattatctttacgtaacatcacaatggaaatgggagaatgggcgctcttttcttgtttgcccactgacagtaaatgtgccctgcagcttccaggtgtcttttctgcctttcttcactcacttatcgagctatctccctgtcaagtggggcacatcccatctccttgggggctgagtgaagccagcttccagtcagcttggggatcacagatggtcccagctccacttaaagataagaccaatcgatcctttctaagagctccacagctaagcagctcatactgcagactgaatttcatttttcagccaccaaaatacaaatgtcctctgcaggtgggcttggaatcccatggcccagactaaattggaaactttctggacatcttgactatttggcaagctatttcagagctccccatctaaactttttacaatgaacctagaaacagtagtaattattattcaacaacactaatatgtgttaggcatttaatatatgctaggaactaagtcacatactttaccttgactcgttaagatttactacaaccctatgagataggcaccttattcccatttttaaaaaatggaagaaaattaagttcagagaaattaagtgacttgttcaagttcaatatcgattaggcactaaaactaagattcaatcctgaatcttagcccgtgctttttcctacttctttttgactagtgtttgcatgatatgtcctttttgtttcaaccaatctatgtctttatatttaaagtagttttctctaagtggcatataattgagtttcatattttatccaattacacaatatctacattttaattagattttttagaccatttatatttaatgtaattatcaaggtttgggtttaaatctaccatcttactatttatttcctctttgtatgatcagttctttgtttctatattagtattttcttgacttcttttggattgactattgtttatcatttcattttatctccactatgggctcattggctgtttagtttttgagtggttgctagaatttataacacatacttatcacagtttatctccaaatgatattatattacttcatatattacagcagaaaagttcaatttctccctttttgtactattgttgtatattttacttctgcatagtctacatactgcataatctgtaaaaaatatttatgattatttttgctttaaatagtcaaatatttaaagaatgctaaaaatgaaaaaaaggctttttttttttttttttttttttttttgagatggagtcttgctctgtcagccaggctggagtgcagtggcacaatctctactcactctaagctccgcttcccgggttcatgccattctcctgcctcagcctcccaagtagctgggactacaggcacccatcaccacgcccagctaatttttttgtatttttagtagagacagggtttcactgtgtcagccaggatggtctcaaactcctgacctcgtgatctgcccgcctcaccctcccacgctgggattagaggagtgagccaccacgcccagtctgaaaaaaaaatctttaatgtttactctcatagttaccattttcggtgttctgaatttctttgtgcagttccacattttcatcttgcattattttctttctgcatgatgatagaagctctttaaataatgtagtaaaaatcatggggttccacagtctgcctatggctgttgctatgaagaaactgagttccaatgtcagcatcagggatctctattgtattgtacatcgtgagtgaggtgaaccatgttgaagcagacagctgagccacaactgtagaaatggtcacttcctacacccataagctgtaaactttggccaaatcatggagtggggtcctgaagagaagatctccatcagaaaggcaagttttggatctccttgttcttgaacagttcctggctgagaaggagttcagattgcaatagcatttcaagaatccgaatcctttcctaccctatctacatgttaatgccctttagaagcagatgtctaaaaagtaaaggactttactagccagctgggtgtttaagtcagctgggaatcctaaaaatgggggtgtatcttctgtaatggagttgcttatcagtcctccaaagaccaggaaccaactcagacttaggaagtcttccattcagtgtcatcattttgcatgaaaagccgagtctggagccaggcactgccatggcccagctccaagagctagtaatgattatgacggcaaataataatgataaataatattaatggaaaatttagtaatatccaagcatcgttctaaaatcttgacagttactgagtcatttaatgccgatgataacccaaagagtagctactattacttattattattttcattttcagggcacagagtatttaaataacttgtacaaggttgtgtggttattaagtggcagaactgggattttaattatggaagtttggccttagagtccatgctcttaaacacacactacattggaatgcttctaagcaaaatggagctccccaccttgcccaaagctgcctcactgtcttcttcacaatctccagtatcctaggttcctttgcttactgactccagagaagcaacaatcacttcattctacctggtctgaatggatctcattcatttagacaaagaggaaggccaatgagtctcaatgcttcaaggtctcagttttcggttctccacattggccaagacttttcagacctctctttccctgagagtgtgttgagggtacctagtggttttttattgggttcaggtttcttgtgttacttcagaaggtaggtcctgagcctgcagactgaaaattctggcttagctggccttcagagctctagcagctgagccctctggaaaacttagccctgaaaataaatgatacttgcctagtaaaactcatcgcagctggcacaacttgcagagttgagtctctgtaggaagcataagcgactaagagacattgcctttatggatttgggatgctaagttaaacagtgcataattttcattggtatgacattattttggaggagaggcctgagatagcattcttaaagaggaggtatttctatcatagcagattggtcctggagacctttgactcacgacatgcaaaatcataaactgaagtgtcttgtatgctaaatttattcagaaaaatagagatcccgtcgctgaagatatgaagactgcagctgaaactcatgtggagctgcctttggggaagtcttagggcttggattatggagacaagggccaggacatgattctggacagggcatcgatgtcttacatgaaaaggaaacagagattctgggatctcattttcctgtgttgctgaaagtcttgtctctccttagggactgcctgactgcgtgaaattcaattcaatgatattgtaattcaaatcctgccagtcacaacatcctgcctgtaatctcagatgacaaggtgatcctcaaagtggtggggctggtttaggggattcgtgggaaagaagaaaaggtatgccatttggcaagctgttagtttgggcaattttgcttcttgacagatgtacctttgtcccagaatgtcccaggaaacagggcaaatcctggagacacccaactatctagtgttaccatacactgaattaggattctatcaaattttccagcaaacagaggaaatagtgtctacaaatagctatgtgactttgggcatgagtgccagcacttgtcattaacaaactacctcattacctttgattcttacacctttctgaaatggtgggactggagaaggaaaaatatatgtcattatatttattctgccattactagcaccataagactatttaactccaaattaattttgtctattaagctgttgtgactctgatgtaatccttcctgttaagacaataagatttgtttttaaaaatatatgatacatgatgcaagatttgagtaatcattttggtgaccaagatcattaaaagaaaccagtagtattcctggatttggacaacaagggcccgagaaccttactttagtggcctcgcatatcaaaatactgaaaaaataaacttactaaaaaacacgtggcccttctgtcaattgggatttagccttccacactgttgcagcgtgatccataagtttaatcatcccctcctgggactgaccctattcaggctcagaaaatgtttctgcacatctccaatgtgcagaaacaaaagatgtactcaaacaaaagatgatttctaccaaatatcgtaaagatgtttgggttgagcagcctggatggaattggagactgttattctaagtgatgtaactcagaaatggaacatcaaacgtcgtacgttctcactcataagtgggacctaagctatgaggacacaaaggcataagaatgacacaatggactttggggactcaggggaaagggtaggagaggggtgaggaataaaagactacacattgggtacagtgtacactgcttgggtacacacagatctcagaaattaccactaaagaacttactcatgtaaccaaacaccacctgttccccaaaaacctattgaaataaaaaataaattagaaaaaattgtggtttgtagtgcttctgacataggagccagatgctgctatggaatgtgggaaggtcttgagagctagaagagcttaggtcagagataggcaaattaacttgtacaaattcttcagattgtaaaaatgcaatatattcctgcataaaaaagcatcatttccacttatgttgaatatccattttctttatactcttggttttccaatttatagttttagaaatatttgcaagttatcatggtattgacagcaaatgcctatggaagctgaggaatattttgctacattaaattatccatattgctgctaaacatgtatgtacaccagtctactctagacctcatgcatgaactgtgtcaccaatggtttatactggcaactaagtggatgctgaagcctgacattacaaatactattatttttataaatgcagtcaagataatttaattaaaaaagaacataagattttagtttttaaaaataatcttgagttaaaatgtataattataattactattttgacttttaattttaacaaatacttccgaataattaaaaataacttttttgaaaacacttaacaatgactttaagttcagtttttaccatttaatttcatttgtatttttgatgaaatattaaacatataagtagattgaatactattccatttaattttctaatcctttagattatcattgtcaatagaatgtaaaataagtaaaattatgattatggcaatataattagtaattttgctaaaatcaaggccaaaacatttttgcaataaatatgtaatcaaacaataattatttcctgattttattactcatctaaacatcactatcttaataactgaacacccagaatacaacttaataacaatcaaattcagttgcctttaatacttggcaaactatcagccacataagaaagataccttcatacatatttttattttgcataatgaagttatatttgccaaagtagaaagatagaattagttttatttaatagtttgttagatgaatttataactttaaacatttagagatattgtatatgggcttccatttattctcttgccccagggcccacaaatgtcagggtcataattgagggaaacaaaaattctttccaaagtcacaatttgtgacgtatatctcttgaggagggactatttacagtattgcctcctagattcaccctcagcaaaaacttttacttggcatgagcaattctatttttatagctaaaatgttgtggaccttgattcactctccaattaaccttggcaaacttagaagatgtggggagtttgaagaacttataattcatttctgcacacaccacccatgaatccagttcacaatctatcactgatcttacacagccccaggagcctgctctgctgctgtcctcctcagaccaaactgggtctctatgccttttcagagccccccctcctccttcctttactactctggacctttctctacctcagcctcctctacatcaaaattctcctactttgtttcccattcctcctgggcttgctctctaccttgcattaaggttttcccaagtccggagtgagctcattaaatctcttgccttggaaaggagcaaggtgagagtaacagggaagtcttgaagcgcttctgagagcagaaatatggcagttaactctggattcagggaagtaagtacccccaggcgagagaaatgtctgtgtatcagttacttttgctccacaatgaaggttgaaagtggagatgtgcagaatcctaactgtgtacttccttcttactggagttgctgtaatagggcagtttgtaattacgtaagtggcaggattatttatcttttaatttgtgcttatttttgctgtagctttcccttcacccactccaagcaagcagccagtctttgtattccttgtattgtgaattttgcagggtccattaagaaatggcaggaagttgactctctttcttttcttctgtgaaagcttgagcttaggggaaatatgatgttaggtatttctagagaggaggagggagaggtagctatacttgaggatggcaggaaaagaaagagagggttttttttccatcccttgactggaaagcggatgcaagtcaggaggctccatgagcactggggactgtgtcctgccccacgacagtttcttacagatagatccatagttttaagggcatgcctcacatgtatatttaagaaaattgaaccctagctcaattctcattcttgcctgtgcctcccaaacacaacaacacagttgctggttttaagcaaccttgtgcatgtagacaatgaacacagcagtaataactgttatggatcaaaaacctgatgccttggcacaaggtgagggtatggggagccccagcaatgactaagagactgaattttcagctactccagtggaatcagggctcatggtttaatgtaagtttgttttgttaaaaaataacttttagctttggaataattttagatttacagaaaaattgcagagagagtacagagagtccccaatatatacctgacccaatttccctattgctatcatcttatattaccatggaacatttgtcaaaactaagaaactgacactgatacattactattaactcaactccagactttatttggatttcaccagtttttccaatgacgtcccctttctgttccagaatcctatccagggtaccacctagcatttagttgtcatgtctccccatctctactggtctgtggcagtttctcagtctttcctgtttttcattaccttggcagccttgatgaacactggccaggtatttatagaaagtcccccagtgtgagtttgtctgatatttttctggtgattacaccgggaatgtggatttttggaacaaatgccaccaagatgaagtggtcttctcattgcatcatatcaggggctaaaattcttctctttaaaaccagaaaaatggacaattctcacacatcaggatttgtaggtaaagattcatcgttgtcatttaaacattcttatacaaaagaagttcagaccagtgtcacctaagagaatcataaccctaagcattgtaattgaaggagaattcagcagctcttgcctttcctctaggagaattcagcagctcttgcctttcttttaggttagtcaatatttccatcaagactcctaacagaccttcttctgtgttctgctgtgattctgggacttgtttaaataccgatttcttaagtatttgaggaagtcttttgaaatcttgtttaaaatcaacttccttgctctctatacttttcataccccttttggctaaatataattagttttatttgaatcttcatgtttttttttaaatacataaaccaagagcatacggttccaggggctcaaaccagcattctctcatggtggtttctagcttacaggaactcattcataataacatatctagactgggttttaatagtgtggaataaatttagaattcataataagaaccatgagaaggacaattatcaaggttattaaaaacaattatttcttacctcattttcactacaactttcagccctcagcacatccaggtcaccatgtaggcattaatcaaaatgtttcctctagcactgctggaaattttgacccatggataatgattgatggtcccttcccagggattggatggctgttctctagagaggctggacatctgacccgggcagagagcattcacaaggcattcacaactctcccacagcaggtgtacatctgttccaccaggatgacatcctcctctctttgtcacagttacttactcttataaaagagttcttggatgttgacattcttctccttctttgaacaaatagaaatctagagacttcacagaatagatgttggctttttaatgattattttagatagaaatgttctgctggtcaacaaatgctaagactgatgttctttaaatacacatgttctggtgtgtaatgatggagttattagagtaaaaggggttcaagagattgcagatacctttatcttagctctgtcccacagagcaatggttcagtatactactggttagtttgggaacaaggctaccatcgttttgtttttctcagccaaacaagaacttacacaacactctaaccttttctatgttggaagtaggaagatttccatttgctccacagtggcgtctttaccataaatatctttcccattacttatgttttcattcacagagaatagtttgataatgttctaaaggagaaaaacataaggaatgtgtgtatggttaaaacacccaacagatatcaaaatgcaagtttcattgcagtcaggcccatgtgagtcaggctagctctgggcagaggtaggtagaaacaaatctgaagaacagggaggagataactataccagtgaatcaacctttaattgtaggctgactgtagataatgaatcagttaacctgttcatttccacaaatgcaaatcctatgctacataagtttggcttttaccaatgggtctgccaagtacaatttaggttgaaccactaacacaaagataaaataaaaattcacatttaattttgttttctaaggatgtggaaggaactgtatggtccatgctcaagcacaagttataattgtccattatgtcactttcattaatatgggccaatagagctagaatgtaacacctatgcagcatcagcaacgcagtaaaagtatctcctgaaggacaagatctgaatctggtaggatcaatgttttcctcactaactttgccacttttgaggttttcaggactattccttgcaagctaaggaaataggaggagtgtcgagatcaaagtcgactctcccaagtttctctctctttttttttgagacggagtctcactctgttgcccaggctggagtgcagtggtgtgatctcggctcgctgcaacctccgcctccctagttcaagcgattctcctgcctcagcctcctgagcagctgggattacaggcatgtgccacgacgcctggctgatttttgtatttttagtagagacatggtttcatcatgttggccaggctggtctcgaactgctgaccttatgatcagccggccttggcctcccaaggggctgggattacaggcatgagctaccacgcccggccctcttgtttaatactattgatacgttattcaaaaagagcaaaatgctgaggcttgaggtcacttgaggtcaggagtttgagaccagcctggccaacatggtgaaactctgtctctactaagaatacaaaaattggctgagtgtgctggtacatgcctgtaatcccagttactcaggaggctgaggcaggagaatcgcttgaacccaggagttggaggttgcagtgagctgagatcgcgccactgcactaaaagtggcaagctgatcagagaaatgttgtaaaatgccctgattatggcccacttcaatgctacaatgctttatatgcattatccccattttagagacaaagaaaccaaggtgtaggaaggtagaatcacttgcccaaagtgacagttagtaagtggtgaagtcagaattcaaacccagagaatttgatgctggcacccaagtgcttagtatgcatctttctccctttcttttctgatctagaaaagattgctaagataaaatgtttgagataaacctagattaaaatcattgataggaaagaaaaccagtcatgaaataatcaggcgttagaaagttgggtcataaattaacttgccagcactgagtagtaacagaattaattgtctcagtctacttgactttagctatgtgttgaaaccagtcattttccttaatgatacttgcaatttgctccctatcttcttgcaattagaagttactttcagatcaactgtgtcaggcacacaggctcctcttttactataaaataccaggacaacaactttaggagcttttggagccacagttaagattgggcaaaaagaactgacttcagctcatgagctggcttttatctgtgtgagaagaatgaaggacagggttgggagacttacattgcttttcctttcactgtcttcattggaatctattaattcattaattctagcctcctctctggaattacactttttttttttttttgcctgttctctcacaagtccagacacaatactttcaccttctgcccagaggacaaaatacttttctgaaatgcctcaactgttatccatccagccatccatctatccatccatccatccatccatccacccatccatctatccctgcctccctctatccatccttccactgttaagtgagaccttatgaattaaatcaatcttatacaatctcattacatcatagaggattcaattagaaaatcctcaaaccaaaaaaataacttcacttattaccaatttaaatgggagcaaatagaacagtttgcttgtcagatttccaaagccaaacaattgtgaacagtgataaagaatagtttgaacactgctgtggccatggagtacactacccagatctcctttctcttggggaagagctgagaagaggatagccggccaaaagcctccagctgctacaccttcagactcactatgacattcatgccaaggtcatgtttccccacagctcctcaaagagagagtctagaacacagtaggggttctagagctgggccatttctgcccgatatggaacatgggcatactttgtattccaatggacaatctttgcttgggtactcaccatccactgggtgagactttctcagagctgtgctatagtcaaaggtgcttcctactcaatacctcttcctttgctttctcctttcaaatgcgtcagacctgcattaaatctaaagtttccctttgcctactcctgctcctttcctattttatccttcacggcattttccccaataaatctcttgtatggctgatctcgtcttggcacctgcctctaagaggaactcaacagaaacaaacaccaacttttcatgtttatacatatcacacatacttggtccattttcaagctgtactcaaccacaattttgagttttgtgcatcatacatgcgtaattcccaaatttaatacctgatgtttaagcttgctctgaaatctaaatgccatatatccaactaactaacagctttacttgatacatccatgtttaatatctcatgtccaataactatgttctatacttcagccatactggatttctttaaaaaaaaacaaaatatttatataaacataatgattctttttttatattattatactttaagttctgggatacatgtggagaacgttcaggtttgttacataggtatacatgtgccatggtggtttgctgcgcccatcaacttgtcatctaggttttaagtcccacatgcattaggtatttgtcctaatgctatccctctcctagacccccactcctcaacaggccccactgtgtgatgttcccctccctgtgtccatgtgttttcattgttcaactcccacttatgagtgagaacatgcagtgtttggttttctgttgctatgttagtttgctgagaatgatggtttccagcttcatccatgtccccgcaaaggacatgaactcattttcttatggctgcatagtattctatggtgtatatgtgccacattttctttatccagtctatcattgatgggcatctgggttagttccaagtctttgctattgtaaatagtgctgcaataaacatacatgtgcatgtgtctttatagtagaatgatttgtaatcctttggatatataccaagtaatgggattgctgggtgaaatggcatttctggttctagatccatgaataatcaccatactgtcttccacaatggttgaactaatttgcactcccaccaacaatgtaaaagtgttcctatttctccacatccactctagcatctgttgtttcctgacttttgaatgatcaccattctaactggtgtgagatggtatctcattgtggttttgatttgcatttctctaatgaccagtgatggtgagctttttttcatatgtatttggctgcataaatgtcttctttttagaagtgtctgttgatatcctttgccccctttttgatggggttgtttttttcttgtaaatttgtttaagttccttgtagattctagaaattagacctttttcagatggatagattgcaaaatttttctcccattctgtaggttgcctgttcactctgatgatagtttcttttgctgtgcagaagctctttagtttgattagatcccatttgtgaattttggactttgttgccattgcttttggtgttttagtcatgaagtctttgcccatgcctatgtcctgaatgatattgcctaggttttcttccagggtttctatggttttaggtcttatgtttatgtctttaataaatcttgagttaatttttgtataagatgtaaggaagggatccattttcagctttctgcaaatgactaggcagttttcccaacacctgttattaaatagtgaatcctttccccattgcttgtttttgtcaggtttgttgaagattagatggttgtagatgtgtggtgttatttctgaggtctctgttatgttctattggtctatatatctgttttggtaccagtaccatgctgttttggttactgtagccttgtagtatagtttgaactcaagtagcatgatgcctccagctttgttctttttgcttaggattgtcttggctatacaggctctttttttttttgattccttatgaaatttatagtagttttttctagttctgtgaagaaagtcaatggtagcttgatgggaatagcattgaatctctaaattactttggacagtatggccattttcatgttgttgattcttcctatccatgaccatagaatgtttttccatttgtgtatgtcctctcttatttccttgagcagcattttgtagttcttgaagaggtccctcatatcccttgtaagttgtattcctaggtattttatttcctttgtagcaattgtgaatgggagttcactcatgatttggctctctgtttgtatattattggtgtataggaatgcttaaactttttgcacattgactttgtatactgagactttgctgaagttacttatcagcttaaggagattttgggctgagacgatggggttttctaaatatacaatcatatcctctgcaaacagagacaaattttgaattcctgtcttcctatttaaatacgctttatttatttcccttgcctaattgccctggccagaacttccaatattatgttgaataggagtggtgagagagggcatccttgtgttgtgccagatttcaaagggaatgcttccagcttttgcccattcagtacgatattggctgtgggtttgtcataaatagctcttattattttgagatacattccaacaatacctagttttttgagagttcttagcatgaagggctgttgaattttgttgaaggccttttctgcatctattgagataattgtgtggtttttgtcattggttccatttatgtgatagattacgtttgttaatttgcgtatgttgaaccagccttgaatcccagggatgcagccgacttgatcttgtttgataagccttttgatgtgctgctggattttgtttgccagtattttattcaggatttttccatcaatgttcatcagggatactggtctgaaattttcttttcttgttgtgtctctgccaggttttgatatcaggatgatgctggcttcataaaatgagttagggaggagtccctctttttctgttgtttggaatagtttcagaaggaatggtagcagttcctctttgtacctctggtagaattcggctgtgaatccttctggtcctgggctttttttggttggtaggctattatttactgcctcaatttcagaacttgttattgatctattcaaggattcgacttcttcctagtttagtcttgggaggggatatgtgtccaggaatttatccatttcgtctagattttctagtttatctgtgtagaggtgtttatagtattctctctgatggtagtttgtatttctgtgggatcagtggtgatatcccctttaccatttcttattgtgtctatttgattcttctctcttttcttccttattagtctggctagtggtgtacctattttgttaatcttttcaaaaaaccagctcctagattcattgagtttttgaagggtttttcgtgtctctatctccttcagttctgctctgatcttagttatttcttgtcttctgctagcttttgaatttgtttgctcttgcttctctagttcttttcattgtgatgttagggtgtccattttagatctttcctgctttctcttgtgggcatttagtgctataaatgtccctctaaacactgctatagctgtgtcccagagattctggtacgttgtgtctttgttctcattggtttcaaagaaattatttgtttctgccttaatttcatatttacccagtagtcattcaggggcaggtggttcagtttccatgtagttgtaaagttttgagtgtgtttcttttttttctcctatttttatttttattattagattatttatttttaaatatatatatatttattatactttaaattctagggtacatgtgcacaacatgcaggctttttacacatgtatacatgtgccatgttggtgtgctgcgcccattaacttgttatttacattaggtatatctcctaatgctatccctcccccctccccccaccccacaacaggccccattgtgtgatgttcaccttcctgtgtccaagtgttctcattgttcacttcccacttatgagtgagaacacgcggtgtttggttttttgtccttgcgatagtttgctgagaatgatcatttccagcttcatccatgtccctacaaaggacatgaactcatcattttttatggctgcatagtattccaatcctgagttcgaatttgattgcactgtggtctgggagactgttatgatttccgttcttttgcacttgctgaggagtgttttacttccaattatgtggtcgattttagactaagtgctatgtggtgctgagaagaatgtatatatattctgttgatttggggtggagagttctgtagatgtctattaggtatgcctggtctagagctgagttcaagtcctgaatatccttgttaattttctgttttattgctctaatattgacagtggggtgttaaagtctaccactattattttgtgggagtctaagtctctttgtaggtctctaacaacttgctttatgaatctgaggctcctgtattgggtgcatatatatttaggatagttatctcttcttgttgcattgatccctttacgttatgtaatgcccttgtctcttttcatctttgatggtttaaagtctgttttatcagagactaggattgccacccttgctttttttttctttccatttgcttgttaaatattcctccatccctttattttgagcccatttgtttctttgcacatgagatggatctcctgaatacagcacaccaatgggtcttgactgtttatccaatttgccagtctgtgtcttttaattgcggcatttagcccatttacatttaaggctaatattgttatatgtgaatttgatcctgtcatcatgatgctagtttgttattttgcgtaatagttgatgcaggttcttcatagtgtcattggtctttttattttggtatgtttttgcagtggctggtacaggcttttcctttccatatttagtgcttccttcaggacctctcacaaggcaggccagttggtgacaaaatccctcagcatttgcttgtctgtaaaggattttatttctccttgacttatgaagcttagtttggctggatatgagattctgggttgaaaattcttttctttacaaacgttgaatattggtcctcaccctcttcttgtttatggggtttctgcagacagatttgctgttagtctgatgggcttccttttgtaggtaacctgacctttctctctcactacccttcacactttttccttcatttcaaccttggtgaatctgacaattatgggtcttggggttgctcttctcgaggagtatctttgtggtgttctctgtatttcctgcatttgaatgtaggcctgccttgctaggttggggaagttctactggataatatcctgaagagtgttttccaacttggttccattctccctgtcactttcagatacaccaatcaaacgtagatttgtttttttcacatagtcccatatttcctgaaggttttgtttgtttcttttcactcttttttctctaaacttgtcttcatgttttatttcattaagttgatctttaatccctgataacctttcttccacttgatcaattcagctattgatcttgtgtatgcttcgtgaagttcttgtgctgtgttttttagctccgtcgggtcatttatgttcttctctaaaacagttattctagttagcagttcctgtaaccttttatcaaggttcttttcatccttgcattgggttagaacatgctcttttagctcagaagagtttgttattgcccaccttccgaagcctatttgtgtcaattcgtcaaagtcaaactcactctccattcagttttgcgcccttgctggagaggtgttgcaatcatttggaggaaaagaggcattctggtttcggaattttcagcctttttgcactgtttttttcctcatcttcatgtatttatccacctttgatctttgatgctaataacctttggatagggtttttgggtgggcatcctttttgttgatgctgatgttactgctttctgtttgtaagttttccttctaacagtcaggaccctctgctgcaggttggctggagttggctggaggtccactctataccctgttcacctgggtatcaccagtggagtctgcagaacagcaaagattgctgcctgcttcttcctctggaagcttcgtcccagaggggcacctgcctgatgccagccagagctctcttgcatgaggtgtctgtcgacccctgctgggaggtgtctcctagtaaggaggcacaggggtcagggacccacttgaggaggcagtctgtcccttagcagagctcaagcgctatgctgggagacctgctgctgtcttcagagccaacaggcaggaacgtttaagcctgctgaaactgctcccacagccacctcgtcccctaggtgctctgtcccagggagatgggagttttatctgtaagcccctgactgggactgctgcctttctttcagagatacgctgcccagtgaggaggaatctagggagccagtctggccacagccactttgcagagctgtggtgagttccacacagtccgaacttctcgttggcttccttaacactgtgaggggaaaaccacgtattcaagcctcagtaatagtggacgccccttcccccatcaaactctatcttcccaagtttacttcagactgctgcgctggcagcgagaatttcaagccagtggttcttagcttgccggggtccatggaattgggacccactaagcgagaccactttgctccctggcttcagccccctttccaggggcatgaacggttctgtctcgctggggttccaagtgccactggggtatgagggaaaaaaaaactcctgtggcttgctaggtgtctgccctaacagctgcccagttttgtgcttgaaacccacagccttggtggtgtaggcacacgtgggaatctcctggtctgtgggttgcaaaaaccgtgggaaaagcatgatggctgggccacatagcacggtgcctcacagctgggaaggggagggaggtccccagccccttgcacttcctgagcgaggtgacgccccacccttcttctgctcgctgtccgttggttgcacccagtgtctaaccagttccaatgagatggaccaggtacctcagttggaaatgcagaaatcacccaccttctatgtgggtctcactgggagctgcagactggagctgttcctatttggccatcttgccagatcctccacaatggctttcttaagagctgttacgtaaaatgccagaaaatgtttccaacttgggattttggcatttgctcttctcatggcctggatcactcttcctccagatattcacatggctggcttcttaactttagtcatagctctgcttcagtgccacctcctccaagaagccttccctaacctttcccttccccaaagaagtgctacatgtgaaagcaccacacatcacacaactcttctttcccttaccctgttctgtttacttcatagtacttaccactaacattttgtttaaaaagaaaggtcaaaaattttttaaaaaagaaaggaaaaattaaagaaaaactaaactctgcttttaatttatcataactgacttggctaattcagccaacttgagtctttagtagattatttgagcaaatgatctacttttaccaactaaaagttattaggagatttgggagatattgctggtctacgtatcatcacaataaggatgagaatagcgatattgccaagttaggtatcttaaatgtatctgacacttttctgaaattacatggataggtgtcactggtaaaatctcaaaatgcagggacaaaaatcaaagcaaacttttatttaaaaatctccaggacaggctgggtgcagttgcttactctggtaatcccagcactttgggaagccgagacaggtggattgcttgagctcaggagtttgagaccagtctgagcaacatggcgaaaccctatctctacaagaaactcaaaaattagccaggcgtggtaacacacacctatcgtgttagttacttggaaggctgaggtgggagaattgcttcagctcaggaggttgaggctgcagtgagccatgattgtcccaccgcactccaacctgggtgacagagcaaagcaagaccctgtctcaaaaaagaaaaaaatctccagtgcaaacataatttgaaattatttcttatagtacctgaatcacatcagtaagtcgttggagaaagaaatggactttttcacgctcctgacattgtacttgcaatccaaacaatagaagtactgtataaaaccttaaaatgtgcatatactttgatctattaattctacttatgggtctctatcccacagaaatatctgcttatataggcaaatatataggcatatgcatattcactctgtcattgtttataacagcaaaaatagaaacactttaaatgtctagcaatggagaactgtcgaaatatatgatggtacaaacacataatggaattctctccaatagtttaaaataatgtagacctacactttctaacatggggagatgtttgtgatttattacatgaagaaatggatgttaaaaatttgtgtgcagtaaatccttctgttaaaaatattgtgtgtataaatacatatgtgtgtatgtatatatatgcatatagacacatagttacctacatacaagcataagaaaaaactctgaaaagacatttttttgaattttaatagatttgtacatgtgtaaattatgggtgttttaaatgttttctgcgtatttttctgtaacttgtagatactttaaaataataagtacacaccaatttttggaataaaaagatttaaacatatatgatgatcatgtcatggaattacagattataagagctgatgggactttggaattcattaaatgctatttcgttcaagagatgcttccattttacctaagaggaaactaagacccagaagagaaattgaattacccaggactcagatttatgtctctctctctccagtcattctcccattttcacaccccagcaggtgctcaattaatgcactgattgatgtagttggttggtattgatgtggatgagtctgagggtgatctcattccactgttgaactttgatagaaaatttcacagtgggaacagagatagttcaatttttccccctgcaacaattatgcaagcctctgatttacattgatcaggacatctccttggatagcaaatgagtttattatagaagttgctcatgtaagatttcctctgcctgcgaatgtttctaattatacctacactactcataggccaattcttagtgatcattgagaaaagcatttctccacataacacattttatttagactttctgaattattttgtataaacgttatcctgatagagaaaccagagctgaagttgaaaataaaagtgttctagatctaattgttgttatcctccccaaaagtttgtagtgtaaaataatttactgttgacaaagaaagtacattaataataaaaattctgaaacattatttgctaaggaggcaaaaaatgctcagactccagttgtatgttcaacactgggcttgtgaaactgatttttgtgatctcttgatgatggaatagccaaaaaagggagtctgtgggagttgcataattgtcaaaaggccattaaaattttcaatctaaaatggaacagaattcatgcacttctgctgaatttcccagttctgtggctcaacaaaaaatgaccacaagttatggtaaccaccagtaggatcttttgttgtcttgccttggcctaaaactgagagtcacaaaatcctgtgcatcttcatcaaagaatcagccttgacacaaaataccttccttttgccacaacttcggtggcgctggacatcaatggagttgtttgcacataataaggaaaaaaaataatgactgtgggggagaagaactctctgccatcacctttcttgccaaaagcttactgcctgaaaaactattattcagggagagaaagtttgtatttattaggtaaatcagagccaatccagtaggtattggacaggagacatttaatttcctcctcagtaggacatcttacgtggcataactggtcctttatacatggccttctttagaaaactggtgtgaactgtaaactgattgcattaagtaaccacaccactgaacattgttgtcttaggtttgtttctctttttcttttttaagcttctatagaatgagttatctcctcagcagtgtgactcacatattctgccctttgcctttcaggatattattcactttgcacgaattagtccagtgcaagattgttggatgaaaaacatggctcaaatgctcttgctctgtgaggataattaaaaaattttcaacatgtccagttttcttgaaaatgtatagtcctgatatatatatataggtatacttacacacatgaatgactgaatgagaagtacagcttatgaatagccttccctatatattttactatataccaagctaatcttttgtatcaatatacaattatgtaatatagcataaagaaccctggaatggaatacaaaaaccctgggttctagtttgggctctgactctagatagttgcatgaatttgaacaagtcacaatatcagatttatttttcgttttaaattttattttgttttcagagaatggtgtgactattttggggctcagaaaatgataccgcaaagtagggtgttttggtatgctttgattaaagaaaattaacgaccttacaaattgcttcagaattaaggtctctctgacttttccttctttctcccctaactgcaagggtgggctttctctgaagttcctttatctgacagaaggtagttcttccaaaagaaatgcaattgccttagaaccctccctggaatctacattaaccataaaatgttaactcttatcacaggagagggaatgaaaagtctccatacccaggacactatgcctagacagacttttcagctattctttcaactattcttccaagggctgtcacctaaacaactatctgcagaataagacaaattttatgcatagtacacttctgcccctcatcttcccatagcttgttgccatctcctccagagcccagaggaactttgtccaaggctgttatctactctttatgcccattcacttcccttaaaaattatctacttttcctctaatccctttcccctatgaaaaggtatttaaacttcaatcatctggcccttccttaagtcttgtattttgtgtggctcctgtgcacatatgcacgttaatcattgtgtctgacttttctcctgttaatgtttttattgtccatttatttcaacagactcaattaccaaacctccagagggcaaggttacccttcactgttaaggcaaattataaaatatgactatggtagattcccttccctcctctcccctcccctcccttccttctttccttccttccttcatatttattgtacacgatgtaatagtttggagaataaaactataagctgggtgcagtggctcactcctgtaatcccagcactttgggaggccaaggagggtggatcacctgaggtcgggagttcgagaccagcctgtccaacatggagaaacccatttctactaaaaatacaaaactagctgggtgtggtgacacatgcctgtaatcccagttactcaggaggcagaggcaggagaattgcttgaacctggaaggtggaggttgtggtgagccaagatcatgccattgcactccagcctgggcaacaagagcaaaactctgtttcaaaaaacaaacaaacaaaaaacaaactataaacaatgccataaacatatccatcatctctaaaagtttctccctgccctctttattaaaaaaatttttttttggtgataagaacacaacagagcggaccctgtctccaaaactaaaacagagggcagccaagatggccgaataggaacagttccggtctacagctcccagtgtgagcgacatagaagacgggtgatttctgcatttacatctgaggtaccgggttcatctcactagggagtgccagacagtggacgcaggacagtgggtgcagcacactgtgcatgagacgaagcagggcgaggcattgcctcactcgggaagtgcaagcggtcagggagttcccttccctagtcaaagaaaggggtgacagacggcacctggaaaatcgggtcactcccacccgaatactgcacttttccaatttgcttaaaaaatggcgcaccaggagattatatcctgcacatggcttggaggatcctacgcccacggagtctcactgattgctagcacagcagtctgagatcaaactgcaaggcggcagtgaggctgggggagggacgtccgccattgcccagacttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagccttgaagagagcagtggttctcccagcacacagctggagatctgagaacggacagactgcctcctcaagtgggtcccagacccctggcccctgagcagcctaactgggaggcaccccccaataggggcagactgacacctcacacgaccgggtactcctctgagacaaaacttccagaggaacgatcagatggcagcattcgcggttcaggaaaatctgctgttctgcagctactgctgctcatacccaggtaaacagggtctggagtggacctctagcaaactccaacagacctgcagctgagggtcctgtctgttagaaggaaaactaacaaacagaaaggacatccacaccaaaaacccatctgtacatcaccatcatcaaagacaaaaagtagataaaaccacaaagatggggaaaaaacagagcagaaaaactggaaactctaaaaagcagagcgcctctcctcctccaaaggaacgcaattcctcaccagcaacggaacaaagctggacggagaatgactttgatgagttgagagaagaaggattcagacgatcaaactactccgagctacaggaggaaattcaaaccaaaggcaaagaacttaaaaactttgaaaaaaatttagacgaatgtataactacaataaccaatacagagaagtgcttaaaggagctgatggaactgaaagccaaggctcgagaactatgtgaagaatgcagaagcctcaggagccgatgtgatcaactggaagaaagggtatcagtgatggaagatgaaatgaatgaaatgaagcgagaagggaagtttagagaaaaaagaataaaaagaaaagaacaaagcctccaagaaatatgggactatgtgaaaagaccaaatctatgtctgattggtgtacctgaaagtgacggggagaatggaaccaagctggaaaacactctgcaggatattatccaagagaacttccccaatctagcaaggcaggccaacattcagattcaggaaataaagagaatgccacaaagatactcctcgagaagagcaactccaagacacataattgtcagattcaccaaagttgaaatgaaggaaaaaatgttaagggcagccaaagagaaaggtcaggttacccacaaagggaagcccatcagactaatagcggatctctcggcagaaactctacaagccagaagagagtgggggccaatattcaacattgttaaagaaaagaattttcaacccagaatttcatatgcagccaaactaagcttcataagtgaaggaaaaataaaatcctttacagacaagcaaatgctgagagattttgtcaccaccaggcctgccctaaaagagctcctgaaggaagcactaaacatggaaaggaacaaccggtaccagccactgcaaaatcatgccaaaatgtaaagaccattgaaactaggaaggaactgcatcaactaacgagcaaaataaccagctaacatcataatgacaggatcaaattcacacataacaatattaacttgaaatgtaaatggactaaatgctccaattaaaagacgcagactggcaaattggataaagaatcaagacccatcagtgtgctgtattcaggaaatccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaacagacaaagaaggccattacataatggtaaagggatcaattcaacaagaagatctaactatcctaaatatatatgctcccaatacaggagcacccagatccataaagcaagtcctgagggacctacaaagagactaagactcccacacaataataatgggatactttaacaccacactgtcaacattagacagatcaacgagacagaaagttaacaaggatacccaggaattgatctcacctctgcaccaagcagacctaatagacatctacagaactctccaccccaaatcaacagactacacatttttttcagcaccacaccacacctattacagaattgaccacatagttggaagtaaagctctccttagcaaatgtaaaagaacagaaattataacaaactgtctctcagaccacagtgcaatcaaactagaactcaggattaagaaattcactcaaaaccactcaactacatggaaactgaataacctgctcctgaatgactaccgggtacataacgaaatgaaggcagaaataaagatattctttgaaaccaacgagaacaaagacacaacataccagaatctttgggacacagtcaaagcagtgtgtagagggaaatttatagcactaaatgcccacaagagaaagcaggaaagatccaaaattgacaccataacatcacaattaaaataactagaaaagcaagagcaaacacattcaaaagctatcagaaggcaagaaataactaaaatcagagcagaactgaaggaaatagagacacaaaaaagccttcaaaaaattaatgaatccaggagctggttttttgaaaggatcaacaaaattgatagaccactagcaagactaataaagaagaaaagagagaagaatcaactagatgcaataaaaaatgataaaggggatatcaccaccgatcccacagaaatacaaactaccatcagagaagactacaaacacctctacgcaaataaactagaaaatctagaagaaatggataaattcctcgatacctacaccctcccaagactaaagcaggaagaagttgaatctctgaatagaccaataacaggatctgaaattgtggcaataatcaatagcttaccaaccaaaaagagtccaggaccagatggattcacagccgaattctaccagaggtagaagggggaactggtaccattccttctgaaagtattccaatcaatagaaaaagagggaatcctccctaactcattttatgagaccagcatcatcctgataccaaagcctggcagagacacaaccaaaaaagagaatttcagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatacagcatataaacagaaccaaagacaaaaaccacatgattatctcaatagatgcagaaaaggcctttgacaaaattcaacaaccttcatgctaaaaactctcaataaattaggtattgatgggacgtatctcaaaataatgagagctatctgtgacaaacccacagccaatatcatactgaatgggcaaaaactggaagcattccctttcaaaactggctcaagacagagatgccctctctcaccactcctattcaacgtagtgttggaagttctggccagggcagttaggcaggagaaggaaataaagggtattcaattaggaaaagaggaagtcaaattgtccctatttgcagatgacatgattgtatatctagaaaaccccattgtctcaggccaaaatctccttaagctgataaggaacttcagcaaagtctcaggatacaaaatcaatgtacaaaaatcacaagcattcttatacactaataacagacaaacagagagccaaatcatgagtgaactcctattcactcatgcttcaaagagaataaaatacctaggaatccaacttacaagggatgtgaaggacctcttcaaggagaactacaaaccactgctcaatgaaataaaagaggatacaaagaaatggaagaacattctatgctcatgggtaggaagaatcaatattgtgaaaatggccatactgccctaggtaatttatagattcaatgccatctccatcaagctaccaatgactttcttcacagaattggaaaaaactactttaaagttcatatggaaccaaaaaagagcccgcatcgccaagtcaatcctaaggcaaaagaacaaagctggaggcatcacactacctgacttcaaactatactacaaggctacagtaaccaaaacagcatggtactggtaccaaaacagagatacagatcaatggaacagaacagagccctcagaaataacactgcatatctacaactatctgatctttgacaaacctgagaaaaacaagcaatggggagaagattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagcaaaattgacaaatgggatctcattaaactaaagagcttctgcacagcaaaagaaactaccatcagaatgaacaggcaacctacaaaatgggagaaaattttcacaacctactcatctgaaaaagggctagtatccagaatctacaatgaactcaaacaaatttacaagaaaaaagcaaacaaccccattaaaaagtgggcaaaggatatcaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaaagtccaacaatgatagactggattaagaaaatgtggcagatatacaccatggaatactatgcagccataaaaaatgatgagttcatgtcctttgtagggacatggatgaaattggaaatcatctttctcagcaaactattgcaaggacaaaaaaccaaacaccgcatgttctcactcataggtgggaattgaacaatgagaacacatcgacacaggaaggggaacatcacactctggggactgttgcggggtagggggaggggggagggatagcattaggagatatacctaatgctaaatgatgagttaatgggtgcagcacaccagcatggcacatgtaagcatatgtaactaagctgcacattgtgcacatgtatcctaaaacttaaagtgtaataataataaattaaaaaaagaagttaaaaaaacaaaaaaacaaaaacaaaaacaaaacaaaagaacacaacatgagatctaccctcttagcaaattcttacatacatatacagtacagtattgttaaccacaggcagtatgctgggtagtcagtgtctaggacatagtcatcttacataattaaaactttgtgtgatttgctggcaagatggccaaagaggaacagctcctatctgcagctcccagtgagatggatgcagaaggtgggtgatttctgcatttctaactgaggtacccagttcatctcactgggactggttggacagtgggtgtagcccaaggagggcgagccaaaacagggtggggcgttgcctcacccaggaagcccaaggggtcagggaactccccttctatccaagggaaaccgttagggactgtaccatgcactctgacccagaaaaggcacttttcccacggtcttcacaactcacagaccagaagatttcctccggtgcctacaccaccagggcattgggtttccagcacaaaaatgtgtggccctttgggcagacacagagctagccacaagagtttttttcataccccagtggtgcctggaatgccagtgagacagaaccgttcacttacctggaaagggggctgaaggcagggagccaagtagtgtggctcggcggggtcccacccccacagagtccagcaagataagatccgctggcttgaaattctcatgccagcacagcagtctgagctcaacctggaaccctcaagcttggtggggggaggggcatccgccactccttaggcgtgagtaggtggttttacccccacagtgtaaacaaagccgccaggaagtttgaactgggcagagcacaccatgctcaacaaggccgctgtggccagcctgtctctaaattccctcctctctgggcaaggcatctctgagaaaaaggcagcagccccagtcagggacttatagataaaacctccacgtccctgggacagagcatctaggggaaggagcagttgtgggtgcagcttcagcagacttaaacatccctacctggcagctctgatgagagcagtaaatctcccagcacagcattcgagctatgataagggacagcttgcctcctaaagtgggtccctgaccccacatatactgatggggagacacctcccagtaggggccaacagacatcgcatacaagagagctctggctggcatctggtgggtgcccctctgggatgaagcttccagaggaaggaacaggcagcaatctttgctgttctgcaacctccacctgtgatacccaggcaaacagggtctggagtggacctctagcaaactccagcagacctgcagagaggggcctgactgttagaaggaaaactaataaacagaaaggaatagtatcaatatcaacagaaaggatatccaatcagagaccccatctgatgatcaccgacttcaaagaccaaaggtagataaatccacaaggatagggagaaaacagtgcaaaaagactgaaaattccaaaaaccagaatggcttttctcctccaaaggatcacaactccttgtcagcaagggaacaaaactggatggagaatgagtttgatgaactgacagaagtaggcttcagaaggtgggtaatagcaaacttctccaagctaaaggagcatgttctaacccaatacaagcaagctaagaactaagaaccttgaaaaaagattagagaaactgctaactagaataaccagtttagagaagaaaataaatgacctgatggaggtgaaaaacacaaagcatgagaactttgtgaagcatacacaagtatcaatagccaaatcgatcaagcagaagaaaggatatcagagattgaagaccaactcaatgaaatgatgtgggaagacaagattagagaaaaaaaagtaaaaagagacaaacaaagcctctaagaaatatgggactatgggaaaagacgaaatctacgtttgattggtgtgccagaaagtgacgggggcaatggaaccaagttggaaaacgctcttcaggatattatccagaacttccccaacctagcaaggcaggccaacattcaaattcaggaaatacagaaaacaccacaaagatattccttgagaagagcaaccctaagacacataattgtcagattcaccaaagttaaaataaggaaaaaatgtgaaggggagccagagagaaaggtcaggttacccacaaagggaagcccatcagactaacagtggatctcttggcagaaaccttacaagccagaagagagtaggggccagtattcaacattcttaggaaagaattttcaacccaaaatttcatatccagtcaaactaagcttcatatgcgaagaagaaataaaatcctttacagataaggaaatgctgagagattttgtcatcaccaggcctaccctacaagaggtcctgaaggaagcactaaacatggaaaggaacaaccggtaccagtcactgcaaaaacacaccaaattgtaaagaccatcgatgctatgaagaaactgcatcaactaacaggcaaaataaccagctagcatttacaatggcatgatcagatttatacataacagtattaccttaaatgtaaatgtgataaatgcccgaattaaaagacacagactggcaagttggataaagagtcaagacccattggtgtgctgtattcaggagatccatctcatgtgcaaagaaacaaatgggctcaaaataaagggatggagggatatttaacaagtaaatggaaagttaaaaaaaaaattaaagagcagtgttgcaatcctagtctctgataaaacagactttaaaccaacaaagaacaaaagagacaaagaagggcattacaaaatggtaaagggatcaatgcaacaagaagagataactatcctaaatatatatgcacctaatacaggagcaccaacattcataaaccaagtttttagagacctataaagagacttagactcccacacaatgatagtgggagactttaacaccacactgtgaatattagacagatcaatgagaaagaaaattaacaaggatatccaggacttgaactcagctctggaccaaggggacatgatagacatctacagaattctccaacccaaatcatcagaatatactttcttctcagcaccacatcgcacttattctaaaatcaactacataattgaaagtaaaacactcctcagcaaatgcaaaagaacagaaatcataacaaacagtttctcagaccacagtgcaatcaaattcgaactcaggattaagaaacacattcgaaactgtgcaactacatggaaactgaatgccatgctcctgaatgactactgggtaaagaatgaaattaaggcagaaataaagatgttctttgaaaccaatgagaacaaagacacaacgtaccagaatctctgggtcacatttaaagcagtgtgtagagggaaatttatagcactaaatgcccacaagagaaagtaggaaagatctaaaatggacaccctaacatcacaatgaaaagaactagagaagcaagagcaaacagatccaaaacctagcagaagacaagaaataactaagatcagagcagaaatgaaggagatagagacatgaaaaacccttcaaaaaatcaatgaatccaggagctggttttgtgaaaagatcaacaaaatagatacaccactagccagggaagaaagaagaatcaaatagtttcaataaaaaatgataaaggggatatcaccagcaatcctgcagaaatacaaactaccatcagagaatactaaaaacatctctatgtaaataaactagaaaatctagaaggaatggataaattcctggacacatacaccttctcaagactaaatgaagaagtcgaatctctgaatagacgataacaagttctgaaattgaagcagcaattaatggcctaccaaccaaaaaaagcccaggaccagaaggattcacagccaaattctaccagaggtacaaaaaggagctgctaccattccttctgaaactattccaaacaatagaaaaagagggactcctccctaactcattttatgaggccagcatcatcctgatgccaaaatgtggcagagacacaacaagaaaagaaaatttcagaccaatatccctgatgaacattgatagaaaaatcctgaataaaatactggcaaaccaaatccagcagcacatcaaaaggcttatccaccaagatcaagtcggctgcatccctgggatgcaaggctggttcaacatatgcacattaataaatgtaatctattacataaacagaaccaatgacaaaaaccatatgattatctcaatagatgcagaaaaggcctttgacaaaattcaacagcccttcacgctaaaaactcaaaaatctaggtattgatggaacgtatctcaaaataataagagctatttatgacaaacccacagccaatatcatagtgaatgggcaaaaactggaaacattccctttaaaaactggctcaagacaaggataccttctctcaccattcctattcaacatagtatttgacgttccagccagggcaatcaggcaagaaaaagaaatagagggtattcaattaggaaaagaggaactgaaatgtctgtttgcagatgacatgattgtatatttagaaaaccccatcgtctcagccccaaatctccttaagctgttaagcaacttcagtaaagtctcaggatataaaatcaatgtgcaaaaataacaagtattcctatacaccaataacagacaaacagaaagctaaatcatgagtgaactgcccttcacaattgctacaaaggaaataaaatacctagaaatacaactcacaagggatgtgaaggacctcttgaaggaaaactacaaaccactgctcaaggaaataagagaggactcaaacaaatggaaaactattccatactcatggataggaagaatcaatatcatgaaaatggccatactgctgaaagtaatttatagattcaatgctatccccatcaagctaccattgactatcatcacagaattggaataaaactactttaaacttcatatggaaccaaaaaggagcccccatagccaagacaatcctaagcaaaaagaacaaagctggaggcatcacactacctgacttcaaactatactacaaggctacagtaaccaaaacagcatggttctggtaccaaaacagatatatagaccaatggaatagaacagaggcctcagaaataacactacacatatacaagtatctgatctttgacaaacctgacaaaaacaagcaatggggaaaggatcccctatttaataaatggtgttgggaaaactggcttgccatatgcagaaagctgaaactggatcccttccttataccctatacacaaattagctcaagatggattaaagacttaaacataagacctaaaaccataaaaaccctagaagaaaacctgggcaataccattctttcaggacatcggcgtgggcaaggacttcatgactaaaacacaaaagcaatggcaagaaaatccaaaattgacaaatgggatcttattaaactaaagagcttctgcacagcagaagaaactatcattagagtgaacaggcaacctacagaatgggagaaaatttttgcaatctatccatctgacaaagggctaatatccagaatctacaaagaacttaaacaaatttataagaaaaaacaaacagccgcatcaaaaagtgggtgaaggatatggacagacacttctcaaaggaagacatttatgcagccaacaaacatatgaaaaatagctcatcactggtcattagagaaatgcaaatgaaaaccacaatgagataccatctcacaccagttagagtggtgatcattaaaaagtcaggaaacaacagatgctggagtggatgtggagaaacaggaacgcttttacactgtcggtgggagtgtgaattagttcaaccattgtggatgacagtgtggcgattcctcaaggatctagaactagaaataccatttgacccaaaaatcccattactgggtatataaccaaagaattacaaatcactctactacaaacagacatgcacgtgtatgtttattgtggcactgtttacaacagcaaagacttggaaccaaacccaatgcccatcaatgatagactggataaagaaaatgtggcacatatacaccatggaatactatgcagccataaaaaagcatgagtttatgtcctttgcagggagacagatgacactggaaaccattattctcagcaaactaacacaaaaacagaaaatcaaacaccgcatgttctcgctcataagtgggagttgattaatgagaatgcatggacacagggaggggaacatcacacactggggcatgttggggggttggggactagggaagggatagcattaggagaaatatctaatgtagatgacggattgatgggtgcagcaaaccaccatggcacgtgtatacctatgtaacaaacctgcacgttctgcacatgtacctcagatcttaaagtatgataaaaataaaaaataaaaaatatatctttgtaccctttgactatcatctcactatttctcccacccttataccctggcaatcatttttctactctctgcttcaacaagtttgactattttatattcctcatatcactgggatcacatagcatttgtcctcttgtgtctggctcattttacttagcatcatgtcttccaggttcatccatgttgtgtcaaatgacaggatttctttcttttttgaaggctgaatacttgtattcatcttctattgctgccataacaaatgaccacaagcttaacacaaattttttagctcacagtgtcgcaggtcataagcccagttggcttgactgattgtgctcctctggcttccacgaggctaaaatccaggttaagttcagcctgggctcttctctggaatccttgggggagaatctgcttccaacctcattcattgtttgcaggatggtggcagaatttggtttaagcaatgggaaaactgaagttctcatttccttgctggctgccagccaggggttatcctcagcttctagaggccacctgcactccccaactcttggctcccttcacctcaaatccagaaacaatgggacatttcctctcaggcttcagatctctcttgcatcttctgctgctgcatctggctctagtccaagaaatatttcttcttttaagggctcaagtgattagattggacctaaccagataattcagactaatctcctcatctcaaagtctaaccttaatcacatctgtagagcctattttaccatataaggtaacctatttacaggttctagggattagaaggtgacatctctggggaacattggtttgcttatcgcacttaccttccctgggctgctccagcatcttcacttctacaacaggggagttggatgaaatcagtgtttctcaaagtatgtgaaaacatgcctctggaggaccacaacacaagtttagtgaatcctgctcttggatctgacgctaaatgacaccgagagtcacacaatgagattgctattcccatgccagtttctttcaagtctttatattaaggcagggaaatagcctgtttggttttagtatttctttcagactgctctaatacttgcttatttcccttcttattgggatgggggttgggaagagaaagataaaaaggagagagaatgaagctcaggtcccccatttcagagcccatctacctagtaaaatttaacaatgtaattttgcttttattgtatttgtttaaactgctatactatgtttatggcaaattgatattggttttccatttacggtattcaaataaattttaattttaaaatcaatacatgtagaaaaatcagtaaatttgaagaaaaatattaaagaaagtaacaattcagcatatatatatatatatttttagataaagtcagttctgtaaaactagcacaaaaataaaggaaactgtggaccttctacactagacaacctcttaattccctttgagcttcaaaaaagttaatttaaccaataggaaaattgcccaaagcttggaaacatgcttcaaaagagaggctattcacccattctccatgatgtgattatttcacattgtatgcctgtatcaaaacatctcctgtacaatatataaacctactatgtacccactaaacaaaaaataaaaaatttaaaaaactaacaaaaaagaagctatccaaatggccaagaaacatatgaaaaggtgcttagctttattaataatcaggacaatgcaaattagaatcatagtgaaacattattacatgcccaccagactgacaaaaattaaaaggtctgacagtaccaaatgtggcaagattgtaaagcaatgagaatttccagttactgttgtgagaggataaaatggtgctctgggggaaaaatgtgaatgactttgaaaaggttactatgtgccctgtctagtgcatctttccaggttattactgcctttcattgtttttcagctattttacagttctatgaattttagaaaactgatagtaaggcaaatgatttttgcccgtagacatgcaaattgtttccaggggaatgaaattgattattgcccaatgtatttttgccagttttgcatctatttgtaaattcattaaagcctatatatttgtctgttctttagattctcctttgaactggctgcaacagttacagtttccttcgttgattaatgagttaaataaaatcttcaatgtattggctttatatttgtgtgagagtcacaattttatatttagaaaaatatgctttaacagtctaaactagaaaacagtttactattaacaagttatgatatgcatagtccaattttattgagtgctataacaagataacacagactgggtagtttagaaacaacagaaattgaatctatagattgcttttgacagtatggtcattttcaccatattgagtctttctatccatctatgagcataggatgtttttccatttgtttgtgtcatctatgatttttttttcagtagtgttttttagttctctttgtagagatcttttccctccttggtaaagtatattcctaaatattttattttttagtgtgtggctgttgtaaaaggtattgagttcttaatttctcagcttggtcactgttggtgtatagcagtgctactaatttgtgtacattgattttgtaacctgagacttcactaaattcatttatcagacctaggaatcatttggatgagtctctaaggttttttaggtagacaatcatatcatcagtgaacagcgttagtttgactttctcttttccaatttggatgccttttagtcatttctcttgcctgattgctctggctgggatttccagtactgtgctgaatagaagtggtcaaagggggcatccttaccctgttccagttctcacggggaatgctttcaacttttccccattcagtatgatattggctgtgggtctgtcataaatggttttgattaatttgtggtaagtcccttctatgctagtttattaagggttttttatcataacgatatgttagattttatcaaatgctttatctgtatctattgaaatgatcataaagttttgtttctaatctgcttaagtcatcaaaagcaattgaaacaaaagcaaaaattgacaaataggatataaactaaagaactttggcacagcagaagaaactatcatagaagtgaacagataatctgtagaatgggagaaaatttttgcaacctatctatctgacaaatgtctaatatccaaggtgtacaaggaacttaaataaatttacaagaaaaaacaaccccattaaaaactgggcaaaggacatgaacagacatttctcaaaagaagacactcatgcagccaacaaacacataaagacaagctcaacattactgatcattagagaaatgcagatcaaaaccacaatgagatgctatctcgtgcttgtcagaatggcgattattaaaaagttaagaaacaacagatgctggtaagaatgtggaggaataggaacacttttacactgtcggtgggaatgtaaattagttcaaccattgtggaagacagtgtggcaaatcctcaaagacctagaaccagaaataccatttgacccagcaatcccattgctgggtatataaccccccaaatataagtcattctattataaagatatatgcacatgtatgttcattgcagccgattcacagtagcaaagacatggaatcaatccaaatacctatcaatgatagactgggtaaggaaaatatggtacatatgtaccatgaaatactatgcaaccataaaaaggaaagagatcatgtcctttgtagggatagccttggcatggatggagctggaagccattatcctcaacaaactaattcaggaatagacaatcaaacactgcatgttctcacccataagtgggagctgaacaatgagaacatatggacacagggaggggaacaacacacactggggtctgtcatgggggcagtgggagggagagaatcaggaaaaatagctaatgtcttctgagcttaatacttaggtgatgggttgattggggcagcaaacaaccgtgacacatgtttaactatgtaacaaatctgcacatcctgcacatgtaccctggattttaaaataaattacaatttaatgaaaaaactatgttcatgtgatgtatcacattcatttacttgtgagtgttaaaccattcctacatccctggtatgaaacccacttgatcatggtgtattattttttcgatgtgctgttgaattcagttgtctagcattttgttgaagattttcacatttatgtttatcatggttattggtttgtagttttcttattttgttatgtcctttcctggttttggtattagagtgatactggcttcctagaatgatttagggaagattccctctttctcaatcttttgcgatagtttcagtagaattggcaccacttcttctttgaatgtgtggtagaattcagatgtaaactcttagcactgcttttgcccatataccagatgttataatttgggtcactattatcattcatttcaaagaatttttaaatgtccatcttgattttattgtcaactcaaaaatcattcaggagcagatattcaatttccatgtatttgtatagttttgaaggttccttttgcagttgatttccagttttattccactgtggcctgagaagacacttgatatgattttgattttcttaaattattgagacttgtgttgtggcctattatatgaactatcctggagaatgttctatgtgctgatgagaagattttatattctgcggttattgggtagaatattctgtaaatatctgttaagtccatatgttgtagattataatttaagtccattggacttggtggaagaaggtaggaggggggtgagggataaaagactacatatcgggtacagtgtgcgctgctttggtgatgagtgcacaaaaacctagaatttaccactatagagtttatttatgtaaccaaaacccacttgtacctcaaaagctattgaaatttaaaaaaactacaaacagacatttatttctcacaattctggaaattgggaagtccaagatccaggcagatttggtatctggggaaggcccattttctggttcatagatggtgactactagctgtgtccttacatggcaaaaggggttaaaactttcttgggcttattttgtaagggcacagatctccttcacacagggaaaaatcaaggagataggaaagaaaaacagatgagaaaacttcattttcaaattgttctgtggcccagatgttgaacatattctactgttttagataaataacttattctacagcagtaaataatatattaaattgatttttttcttagtaataagttttcttcactctaccattttacttttcaatttctattagttttagatatcatttattgcaatatcattagattgagatttagatatgaaggcatgttgtaactcataaaatataatatgaagggtacaacatagtacttggtaccgtgaatgtacctgttcaaatttaccaatcctcctttgcatagtttcatgaaagaaatggttttggctaataaaattcaggcaaacttagactttaaaaaatcaaaatgacatgttaatccttatatttataaatatcctgaaagataccttaataatatgttttttaataatactttaataataaaaatacattaataataggtacagaataaaggatgccatttttatctttaatactaaaagctaatctacatttttcctagatattaatattaaatcatgcagagtaggtattttgctgtgtttcagcccaattcttgacagaaactgcaaatttcctataatctagaatttccattatttctttagcttaaactatgctggaaaaataaataattaaacaatccgcaggataaacgaatgggtccacttgaaaaaccacaaagtagggtgtcaatgtaacaagattatatccagaacacagagtgagctctagataaatgaccatttatcaaccccttaaaaatggcctcttaaaggaatggacaccaaattccaaaagcactccattattcagggcaatttcttaattaaggtgcctagaacctttaaaccaccgtgacaataagctctgcttggcttcagagacccgctaatatttgttcaaagagatctttctgtagccgtgtcatctactactatgattactctactgatcccgtgactataatggctgctactactgatgtcacagttctcatttgttgagcacttaccctattctaagttttatatgtgtaggcttgaaccaagcagatgagccattaacagcagcatcacctcttaggtagagttggtcactcgccattgcaagatgaaaattgtgtacattctaaatcacccttgacagctaagctgtgggtatgcaaaggcatacagagtagtataatggacattgaagactcagaagtggggacggtgagatggggggtgagggataaaaaactatatattggataaaaagcacactattcaggtgacaggtacactaaaatgtcagacttcaccactataccatcatccatgtaaccaaaacaacttgtaccctaaaagcatacatatatataacaaaccaaaaagcccataaaattattcttgaaatttctttaaatcacccatttttggtaacatctttgtctactgacccatttcattaaataaatcaacaaagcgagttttcccctgcagcattggaacagatcactctttagttacatgaggtggtaggataatttggaggtggggacatgtgtacaagttgactgtaaatatcatgtggtctctatttttttaaaaaaaaaacacgtagtactatttaataagtagtgaaataaactcaaccctttctcttcacagtggattctttctgtaaaacataaattttattaggaagcaattagtttatgttttagggaatttgttaagcttacatgtatatgtttaaaagtaaagagcacacacatccctatcatgcgagggctgaaacagctgactttttagcttacatcatgactcaagtcaagatctcaggcattaatttggatggctggagaccctgagatttaaatcagtgattaatgagtctttaaatggctggctgcttatgtgtaactcccaaggtcggtattatcttatttatttttaaacacacttcaacaagacagtatatcttgcagagaggctgcgtaaagagagaaattacactcatggaacatttagaatattgattacccattcccatcccagtgttctcataataattacttagtgatgttttaaaaggtataagattatgtgtgctttatagacaataactttggttacatttcagtccacaaagcacctttaagttctgcttttcttaagactaacgggagaaaagcattgagttctggctataaaataaatacaaaataatgttctctgttgttggaaaattgttagtattgcttgtgtttcttgttcatagtctgttttgaccaaaggctttcttcaagccaccacatctttgaagtattctccttttgaataatactcagagcaactgagatttatggagcaattttaacttttgcaaacatttctacaacagtaccaagtttatcctccctccagtcaaatatgcttttccttactttactgatgcaaaacatgattaaacagggatttagtgccatatttaaggtttccagctatctatgatctgttaggaaccagaacccaaatcttctagtttttaattctgtgctccttcagttaagctgagccatgacactaactggttgaaaagttcacctccaagtttctgaatttgtcaggaaaaatctcctgagatattccttgttcagttctgaactcgtatccaatagcttattggcatctctatttggtgaataaacatcttactcttttgtcattgttccttatagctttttaaaatacaggcttattgagatataattgactcactgcacatatttaaattttcaagcggatggattgtagtctctgtatgtatccatgaaaccaacagcataatcgaggtaatgaacatatccgtacctccccaaaatttcctggtggactttgtaatctatctcacatatccgaaacggaactttgtattttaaactctaaacatgtttttaccttagctgtccctattgtagcagactggactgtcatccatcctgttgctaaacccaatgccctactccccatacatgctatctatcagcaagtcctagatactgaatccatctatatctcttcatctttctggccacctccctagtccaggtcacctggtctctacaatgtggcttcataacaggtctgtatgtttccattcttactggacataatttattcttaacatagcacctaaagttgtctgttaaaaatacaaatccagttaagtcactcccttgctcgaaaacctctcaacggctttcagctgcctctggaatacaatgcattctcctcatcatgccttaccagctcagctgtcatcagctgctaccaacctctctgattgccatctccttccactctactacttcttccactcctctactcactacatgccaacatctcctcctttcagcttctagaacaagaaaagcatattcttgccaccatgtctttgtatctgctcttgtctctgcctgaaacattgattatccagttttatgtaggttacctccttctcatcattcttttctcagatcaaatgtcatctctttgaaagagtcttctcagacctcactatctctcctccccatctccaagtcattctctatcctacgttttaatagcacttctagtgtttggaattgtttgtttccatgggtttaataactggctcttccactggaatataaacttgagaactctgattcactctattattctatatctgaaacattctaacagcatttcacgcattatcttatttcatcttcataacacatctatgagaaaggaccattatcatcattgttttaagtcaaggaaactgaggctcagaaattttaaataatttgttcaagatcacacagcaaagaaagagtgaacccaagtagcctcactttaacctatctgcatgctgctcaaacaaatgaatttctgtactctctctattctgtactgactctattagacaatactcatgacacctggattgaaatcccaactgtgtatctctggataagtgctgaacttaacctctctaatttgaattcctcatatgaaaaatagggataatgcagaaaataactcagatgataatcatgaagttaaattagtgcaggtcgctggttctcaaagggtggtctctggaccagcagtatcagcatgacttgggaagttatttttaaaatgcaattttttgaccctactgcacaactaccaaatcagacactctaggggtggggctcagcaatttgtagtttaatctgtcctccaggtgattttgatgcacactaaatgtggagaattactggtaagtaaaccttttagttagtgtctggcacagaataagtgaacataaaaagggctagtattaacacagccaggtacagtccaacgatgttctctttagcaggacaacttcttattaggcctgtccctcacatttcagcatgtttaacattcttggactctgggcattaaatatcatttgcaactccttcaaattttgtgactaaaatatgctttccatgtgtaccaaaagctgccttttgagggtgggagacttaatactatctccagttaagaaccatagctcactaatcagaatgactctccaatacgttttcttgttcaggttacaaacggacttccgtcaaagggatacgtgggtatgaattggaagaatctgagtggaaatgcaacactgatattttggatctccagaatttgcctataagaagagtcatttattcaggaggtcctgaatttgcttataagaagagtcattctctgcagagaatgcaaaagatgagtcaagggatgattctgcaatataattggaggatgtaaagcaattgcaaaaataattctgtctcatggaatactgaatgtctctaggaaataccaaccaatattggagttctgaaaaagtgataatgagcagtatactgtagggaactaggaaagactacttgacaaagatagtatttgagatcatagataagtgctttgggccaaaagaattgttactttctcagtttagttgaaagcaaataatgatactgtgctcatttttatagacaacaatagcacacatgtatgtggatgaaaatgagcgatacagactaattatgagtgaaagaaatccttgcagaactaacaatccagtgttgtccaaaacaaaccaatggacaaagtatttgaaaatgctagtaccatcctaacatcccaattgttttgagcaaattcttattgatagagatctctgggcctgcttatcaaccagtgagtaactccaatagtcaataaacaaatgctgcctccctcattagggatggatatagatggaaatagaatttcagaagagttgacagacaagccaaatattgtcaactttcaaatttgtcatgttgcccctagttcgagcctcactgtccaaatcccagagaaagagatggtgggatgtgaggaatggagataatctgtgtctctttgggatgttttggggtctacttaaggccagcatgacaaacatgtatagtgacaaccctaatcaattgttcatggctgtctgaaagggttggtgaggctacagtgagcaataaaaaattgccatcagtaattggccataattaccttgaacaagtggcaacttgtgataggcaacagtttctatacagtggtaaaacatgtcttatactgttccagagggtatatgatttaatcaacagtacaattgaagctgtattgtattggggcacttaatattagaattttgctaaaatatttgatttctatttagacacacagatctctaaaagatagttttctgtcttgattacatgttcttcacttcattctgaatcagattggaaataataagttgtgctttatatgcttggtagctcattcattcattcacaaattcagccagtcagccactgtcctagttatctattgctgggtaacacatgacttcaaaatttggtggattgaaacaacaacaattatgtcattatctcttccagtttctgtgggtcaggaatcttggaaggactcagctaggtggctcagctcaggttccctttgtggtttcaagtcatatggtggctgggagagtgtggggctgaagcagctgggggctggatgggcagcttactgtcttcatgtagttcctgggcctctgcacatgggttaatctggactccaaaggtaagatgtaccaccttttatgacctagcttttgaagttacgcaatacacgttgagcatccctaatttgaaaatctgaaatccaacatgctcccaagtctgaattttttgactgctgacatgaagccacaagtggagaatttcacacttgaccccatgtgacaggctgcaagtcacagtgcaggagcataacaagcagtttattctgtgcttccaagggaacaaagacccttggagccctcctcagctgtgatgtacatttgttgcacatgttcagattctcccatgcaagcaaccagactgtccacataggtggttgctagtgacatatttaccttctgatggctcagtgtatacaatcttagtttcatgcaaaaaaatatttaaaatatgatatgaaataccttcaggctatgtatataaactgtatataaaccataaatgaattttatgtttaggcttgtgtcccatctccaagatatctcattatgtatatgaaaatattccacactccaaaaaaaacactaaaaatccaaaacacttctgtcccaagaatttcagaatagggatacttagcctgtatcacttctactacacactactgattataagctagttataagactacccacccaggttggagaagaagggaagtagtctgcacctctttatggggatgtgactagggttttagaaaacatatgggataggagatgatgttgctatcttggaaaaatatgatcagctgattagccagagtcacaaacatttgttgggagccttttatgtgctaggctgcacatactctgggaatacagtgaagaggagggacaatgtccttgctcctgagtggcatatattctactgaggatgagtgaggagataaacaagaggtaaatacacaggaaagacaagattgaattgtggtaagtgctatgaagaatgttaaacaaaacagaataactggggtttggagagcttctttagataaggtggtcaggacaggtctctctctctctcttttttttttttgcttcagtgtctattttatttatttatttatttatttatttatttatttatttatttattatactttaagttctggggtacatgtgcagaacatgcaggtttgttatataggtatacatgtgctatgttggtttgctgcacccatcaactcgtcatttacattaggtatttctcctaatgctatccctcttcaaggcccccaccccatgatggccctggtatgtgatgttaccttccctgtgtccatgtgttctcattgttcaactcccacttatgagaacacgtggtgtttgattttgttcatgtgttactttgctgagaatgatggtttccagtttcatccatgtccctgcaaaggacatgaactcatccgtttttatggctgcatagtagtccatggtgtatatgtgcaacattttctttatctagtctatcattgataggcatttggcttggttccaagtctttgctcttgtgaacagtgctgcaataaacatacatgtgcatgcgtctttatagaatgatttataattctttgggtatatacctagtaatgggattgctgggtcaaatggtatttctagttctagatccctgaggagttgccacactgtcttccacaatgattgaactaatttacacttctaccaacagtgtaaaattgttcctatttctccacatcctctccagcatctgttgtttcctgactttttgatgatcgccattctaactggtgtgagatggtatctcattgtggttttgatttgcatttctctaatggataggtcacttttaattaaagaacttaatgagaagaaaacagtcagggaaacaagagttccaggtggatggaagagcaaaaatacagcatgtgaggtaagaatgaggttggctcatttgagaatcagcaaagggcctggtggcaggagtgcagtgggcaaggaggaaggtggcatgagatcacatctgagaagtaagctggggatagagcatagagctttgaggctaaaaagcatggattttgtttcagttctcctgaaagttccacaaagggtgacactctgcttattcactcttaaagctccagtgcccagaagcctgtctaacaaacacctggcattcacttgagctctgctgaatagagaatgactgaatgaacaccagaccttaagttgccacctgctcatatcccactgcaagctctacatggtaaggacatgttccatggagacagagtggttgagatctcacttaaactctttagcttaggactggctgggctactaaactgcatctattaccacctaaatgaagacacataacagggagctaattataatgtgtcttgccctgctcttgaaaaattaaatgttttattgtgatgttacaatttgaatttattatcctttgttggggaacaaaattaaacgtaatgagggctgttagtctcctctcagttctgcctgtatcctgtaccttatatcatttttaccactttgattaatgggtttaatttacttcgactgggatatgtaggaatcagtaggtggggggaagttgagactgttaaaatccttttaattagactaataatgccaaatctgcatgtgttaacaagggtgcactattaattagctttcgtagatggcttcgggaaaggtagcagagtagctttgaaatatcctttgtgatatcaggaaatctattaagttgacaggcaaagcatgacattacatatttcctcaaatgaagagcctttcatctctgaagacatagagaatctcacatgacagacctttccctagcttgttgtgtgagacgtcttttatggaccctccaagttcattcctgccccttcttcgctctgctctctgtcctagtgctgacctacatggaccatatcagcagggcttctctgtgctctgcctgctggttggatttggccaagagaagccctagcaggagatctgggtattgaatctttgacttcccccactttgagatcaccagatttgtctccaaagctggctatgtcccttgacccaagctcattgctactcaagacaactttctctatacaagtctctctctgcattctgctaatatcttcccacttttgttctcttcaagcctagggtagacctatcctaggatccttctaggatcccagaagaccctatgaatttctgtgccatgccctttctccagatacttgatacatttctccactcaaataattcttttatataacttttcatttttttcagtagtcttattaaatgtgacattctatgttgaatcctctctagacatgtttgcagtgacttgctgatatttccaatcctctctgttagattgtcaatcggtgggagcagggactgttttctttgtttcccaagtgccctgtacagtcacctcgacagacatatgctgaggcaataaatgaagaaagacaagagaaattcacaaacacaccaaaactagttggcacatcaagacttcttttttttttttgagatggagtcttgctctgtcacccaggctggaatgcagtggcgcgatctcagatcactgcaaactccgcctcctgggtttacacctttctcccaactcagcctcccgagtagctggcactataagcacctgccaccatgcctggctaaattttttttttttttttggagatggagtctcactctgtcacccaggctggagtgcagtgacgcgttctctgctcactgcaaactccacctcccaggttcacaccattctcctgcctcagcctcctgagtagttgggactacaggcacccaccaccatgcctggcaaatttttttgtatttttagtagaaatggggtttcactgtgttagccaggatggtctcgatctcctgacctcatgatccacctgcctcagcctcccaaagtgctgggattacaggagtgagccaacgcacctggccggcacataaagactttaaaaatgttaaagcgataacagaatttaattctgatgaatgaagtggtgatgaaagtggggttggctgctaactggacgttgtgtgtgtgagaggtggggggaggggtgggatgggcagttttcagaataggagacaatatctgtgagctctatgctgtcttgttccagaactcaaactgtggcaaagacgcaaagccaggagaaattgtctcgacaaccaaaacaatctgtaaacttggatcaagaggacccatcaatgacaagaatacacacgaaaatcttttggccactcttgaaacagatcattctaatcaacaggcaataacagtggggacacctgggccacaataaaccctttcacaactgtgccctttaccttgggccctcatagcccctctgctgggatttgcaagtcctcttcaacaaggagttcccaaaccaagggccaagacacatctggagactgtctcttgggtttgacagttgtacttttaagcattcctgcccttctggtttcttgatcctttggctcatttatgagaagcactgtgtaatcatctgaccctgagccaagaacagaggcctacagaggccctggctaatgtgggaactaagctttcagctttgtgggctgagtctgctgagctaagcagcttcctaggactgtcagaggattggtgctacttaagtgcagttgttctattacactcttttctatgagttggatgagcctttgcggattaaacagttgtttgcacttccccagttccacgctgacttttataacatatcaccaaaaggtgtttcacattgaatggagtgttataaggttccatatggtgaggtatggtttcctcctgcctggagttctgaatcattctgcaatttgtgtgaatctgctttgctatcaggtaatgaaataaaatgtacaattggtcagatttttttttttgaaagagcaactgcctacattttatccagaaggtgccagatagtgagtaggttgattatggatggctgtcaagcagatggcactatgtaacaagcactgatttaaaatcaaggatgattgtgttctggggctcactgccaccaccagtttccccgagataattctcaagtaactcctctttggataaatcttccctgacctctctactccctccctttcccccagtctgggtttgatacccctcccccctgctcctgtagtacccttaactttatgaagtacttgaaacaacgataaagtgcaaacacaatggaaggtagaatgaggatgtaaaacactttgatgtttcaaaaaatagtatttctcatcacttctagtttaaagtctcatcgttcatgtcaatacgatcccaccaaggtaactatgtttctggtattttagcctcattgattctggattctcctctctaggttcttgaagatggggcaaggtactgtcccaacatcagaggaaggatgtccatatccttctggttcctgtgctattcttgatccttactggcctccaagtagaaggcccttgctccaagggtccctcaccatcccattctggcatatggtgaggtatgcctggccctgccagatctttgggatgtggtgctggctgtcactgctgaagtccatggcccctctgccaccttcctctgataccactaaactcagcaaagaagactggagatgtatgttacacatgtgactattgtaatgaattcagatatgcttttcttctgatacagaaaatattttataattaaaagaagatggttccttatatatgtgccttttcaatggccatcaacaattcatagctacagattctgctatgtctgcatagcaacagactcagtctgcttataccttatgaattataaatttactcatggacgagtgtgtgttgttctctcaaaggtttgattatttagattcattaagtgttgtactcgaaagaaataagactggtaactgtattttaataaagtatttaaatacctaaacatgttaatattttaacagatataagagtgtattgtgctgtaggtacaggtatttattattgttgttattgtttttaaatagagtaggacttcgaaaggaaaccacaaggaactttaagtcctgcttttaatcaccgtcaccttattttacaaagaaaaatatatttcattcatgtaagttgctattcatatttagttatatatttctacattatgaagaaagtattcaccctgaggcggggaaaacagaatccccagttagctcctattgaatgcctccatcctggaatactgtacaaccgacacatgcattggaattattcatgctgcttgtataccttgggagatgaacaccttgaagacaaactcagaatttcagtaagtctaatcttgattattatttttgcaatatctgaaagtatatggtcaataatccaaactagcagataatttaaaatgatttaaatttaactgtgaaatatgttatatatctaatcccctctagacacaattatgttttacctacatttgtatttaaattgatttaaatactaactagtgtggggcaagctaagttatcaggtaaaaatgagcttggaacaaaatacaacaggcaaagtagattaaagattaagacacaatttcattttctattactctttaacttctaggcaagcttactatattaaaaagccacatttgtcacattgttctcagataatatttttttctttcagatgaaagtgacacacgaatgttaaaagtcacaaaatacagccaaataccaacttttatttcattagtccatgtccacaattagtccaccaatttgttccatatttcaaccaaacttaataatttgaacttgccccaaatgacttaaagtttctgaactttgtattatgctttcttctttgccagacacactttctctgcccttgccatgtgatttagagctcctccaagtcaggagggtgtgatagaaatggcttctgggatttggagcttgatagggatcacacacatacacacacacctccagcccccaaaactttgcaataatgaccaataataattgtgccctcctctaagacagccattgtgtgtgcgcttgacatgtgttattgcctaacactttgcattgtgttgaggtttggaaactgtcagaaatatttaaggcactgcctaggaaacaaactaagctcatgtctcaaacaccagaaagtactctataatcttatatttggggaaatctaagactcagagcaagacataaaaaataaaataataattttaagaaaaagagctagacagatcatttaacttaaaaaaataaataagctgcaatttatgacccatcactgtctcctaccttagccttgttttacggcttcacgcaagtactaaagcatgtttagtcaacacaaaccttgggattaagggttacacactgtcaatggcttaggcttacctctgtggtgtaaattacaataaatccttatttatttatactgaacactggaaaacacaatagatagaatctgtaacttataagaaaagataaaacacaatctcactaaattttatgaaagaccactgcatcttgtctaactttgaaccatcacagcgttttgctgaatcttctaacatgaaatttcttcttgctttgtaggttttgtttgtcttaatctctttactaaacactaagcaatctaaaacaagaaatgttttttctcttttagaaaaaataatgccacagcattcagcctagtgtcccacaaatgactgaatctcaaaactgtctcttgaattgaattttgcctgcagataatacagacctgaacacacttgacagccattgaaaatgcttctttcccctcatatttaagaaatggaatagcctaatggtcaacagaaaaccaccgtaactcaaatcctatctctgtcacatacaagttgtttaactttagacaagtctttctgtgcctcagttctctcattactcaaatagttaaaaaaaattgagatgtaaatatatcaatatatgtaagatgcctcagaaagtgcctagaatgtagcaaacactttacaagtattaattattatcattattattatcctagtttaactctctgcaaaaattgagttgagacttcaaaggaatggctaactaaaaatacgcatgcctcacaaaggatatttgtttccaagagaccacaaatttataaatcttcctcctctctttccctgatggtcaaatacatggacccattttggaaatgtaatttcctactgtctgtgaaggtaacacccctgcctgttctcctaaagtactcatgcaaattaaacagaatgaacttatggaaaaagagacagagtatgtagggcctctagagatggctgtctgattttttgttgggcttatcttctgatttcatttcgatttgggatataagaccaggggtgttttgtggttagtgtgaggtcaaggacagaaaacaaatccagtggacaatactacctcatcggagagcagaaaatcataacaatttaatacagcatcaatgtggctgattaacagtccaaaaattagtatttttctttttcattctgattaggaataagatagtagccttactttgaaaagcccaagaataacaggtattccacaaacaggttaacactgagtttcttcattagggactcctccccttcccatccttctctctcttctttctctgttttactgtacacctcaacacctgtgaggagatcatgtataagcataaaagggagtcagtctcctgtgttgtagaattaatgaggtgtccaaagggccccatctcattcctttttctctaattccttcttgaatttaaaggccttgtctagcttaaatacttcatttaccataaaaattacttactggggctttttaacacactttgttcaatctttagcagataaagcagaccaaaaactaaggatatagaagagttgggaaatataatagaaaattttgctttcatagctatgtgttaaaatttatttcctagagagagactacattttttactaggcctcaaagaacatctcaacaaaatcctgaaattggaaattatataggcctggcagatgagcagagaggaacgtaggtaataaggtcagggtgggtaatttttaagagggcccactcatgcaagggttgagggaagaacctccatgaggaaggtcggcatggggtaagggcatgtcagtggtggtacactttgtagaggaggacacatgtaaaatggcactatcatttgattaccttctttatgagtctcttggacaaatactaatgtttcaattacatatcactgttgttttctctagcaacttttcattgcagtcttccccaatgtggtgtcaatatattaccttacaaaattgttaaaatgtgacagtttagaaaaatgtgctctagtggagctcttttcccaccataccttccattcgtagccatgcatctgggttattaccaagaactttgactggggaggaagagggtgggacatatctaagaactgagctggaaagccaatggaaatcaaattttgctgagcggagctattgggctactatgggcaattcaaatacttactcaaagcatcagaaatatgacttaaacctggtcttgatttcagtgttgtagggaagaaagagagagagagaggcaagtatagtccaacccagtaagagttatagaaatgttattggtccaggaagggagtactgattggtgagaaatggaagggattgctagcaatacagggaagaagtaactttcttagctggtccaataagaaaagggtgagcagaaagactgagggaagaaccttagataagtcttgcaaagaagaaagaccatagtcgatagacagttttgggaaccccaaagaccttcaaaataagtactccagtgactaatgacagtatatgcttactctagctttcttgacattcaggaggaaacaaccaaaatcctttctcttaacagacctgtgaaggcaatctgcttctaagatagatttcagcccctagggtggaaacaccacacatttaccaaaactcttcaaattcagttaagggtaggaacatctcattttttccttctgattatccatggcattcctagttgtatcctttttatatcataaaaagaaacacattatgattataaaagtaatgcatattgaaaaaatacaaaaaagaaaacaataaagtcagtaataactctgttacccaaagataaccactgtgtgtaatattgtggtatgtattgctttttccctatacatatgtatatattaaacaaaatttaaattattaacaaaattagacataagcatttaagaacctgctatatccccgtatcatgaaatttcttctgcagtatcagtcatactgcatagtattccacattatggatattctatttttaatgttctattcttgaccatcttagattatttccaattttcacaacctttaaccactttttgactaattagactttctctggccttcttcttctcgtagacaaacccctcagggtctattcatggaagcctggttgggtctcttcttttggagaactaataaattagtccacacaactgaacttgctgaaggtaaatttggagttggccaacttttgctgtataacaagcagtgtttgtgtacagtgtctgttaggcattttactatccactggctaatatgttcagggcaggaacatccctttctaccccatggctctcccttttctctacatgcaaggaagtatgtaactgggcacagtgctgctttgatctggttttcattatgtgataattgtggactttctaaattgtaaatgtctgtgactttttccccagcagtcagacaatctatgctctgggaaaattaaagggaaaaatctcaggtaacaagaggagcaacatgaagcaatactttgctataatcatcctcttactagctgaggtccaaaatgctgtattgagtgaaataacatgattagagttaaataaataatgacagctaagagagaaatcagctagaaagaagttatttcagcctattaagaaaggagatgagatgttgctcaaaggaaaaaggcccgtatatgaagagtgtcaaaataaaggaatgaaaaaagaaataaatgaagtctgaagagcatgctagaaaaggcagatggataattttaagcaaaatgtgttgcacagtgggattggagctgaatgggaggaggtttgattgtgtaagcagttccaggtttcttgctttataacagggatctgcaacctttttctctaaagggctagatagtaaatattttaggttttgtaggtcagaatatctctcactctactactcaatgctgtcattgtaacatgaaggcaggcatagacaccacctaacaaatgggtgtctctatgttccaataaaactttataaaatctgatggtaagctggatatagcccacaggctgtagttctgtagttctgactcctggtttagatgatcaaagtggtggcagttcctttctccattgaatgggactcatattagtttggtgcaaaagtcattaattttgcaattaccttaattaaaggtgccattacctttaagggaaaagaccacaatgacttttgcaccaaagtttggtgtttgtgaggattaaataacaagtgtgaaaagtcctaacacagtgcttagcacaaggtccacactcaaatgttatctcacccaccgtctttcaagtcagtgatcatactccacagggaagcattcatggcttcagttaatcgtgcatataaattgaagacagaaaaacaggtagaaaagaaagacatgataaatgaaaggtcattattgattttggtttggtttttcaatacatacaactcaggacaaatcattaaaatgcatcttcttgcaaactgaagaaacagagcaaagtacaactacaaaaacaaattatctcaggttgatataattttcattttcatgacaataggctcattttcctcatctttcattgagcttgttaaactttaagaaaatccctacttttaagaaatgattttttttaacagtagaggcagaaatatactgatataggtgaattgtacttaaccaaaattgtaaaatcgtctatttaacattgttaatttcagttaaatggcatctcaattttgactggaagtagaatcactctggttttggtttttcatagactctgagtagcaccactgcaggttctttgaagcatttctaaatgaggtaattttattttacaaggggtttcttgtaaaaactattgtctttctgtacatctaattaaaataaagatgtaataaagaatttactgttttaattagggcatagatcttaaagcaattatcctgtcattaataattccttaacagactttcttgcacaagatgaataaaaagatttttaagctgtgaaaaatcaatacacattactcatttacattaacaaagctacacaaagtaatctgagccttcattaaattatttctcctgtaaaccagagaagtttggagagttattagctatttataacctagtggaacttcacttacaagagagaaatcttacccatgactgggcagttgtatcaatgtcatttaaatgaacagccaaataggattaatatattagtgagtggaaatagattgatatggtccataaggatgactaaatgatgaaagctatcatcatggtgttataatatgaatgattcagcactccatctgaaaattacatgtcttaacagttttttttcagtgttgtaattaaagtccctcccctccatacccccaccatctgccatatacacatttggctgtcttttaggcaatgtagcatctaggagacactaagatcactgagcttaaaatacaatcatgaaggtatctcaagtagtattgccagactttggtattttctataatttcatctaatattataggataatctgggaagggcaaaaccaaaccaaacaaaaactcaaaatgatttttttttgttagaaaaggaaaggctatgttgttatgagaagccattaagaagaagaaaaaatattttgcaatctaaattttagttacattgtccctaattgataatttggaggcagatggaaacccttacatgtgaaagcaaaaggtccaagaccacatattgtccagtttccctgcggaagaattgtctaagaaattaaatgaatcaatccgtaactgcaacagggactttgggtccttgttcctgtctgtgttgtttcctgagcccatcaaggtgacggttaatgggaagaggtattaacacaagttcttgttgggtcatttggtaaagccctcaattagcatggccagattttaatgaatattaagtaatgatgatgaaattaaaagcatccggaaagacagcagtaatcaaaccggtctgtgaacgtatggctgaaaaagctgttctggggtccttgtgagaaatttgctccaggacccttataagaatttagagaggattgctcaccaatttttcattatatatatatgcctgtttcaatatatataaaacaggcttaatggacctcacagttccacatggctgggaggcctcacaatcatggcagaaggtaaaaggcacttcttacatggcagcaggcaacacagaatgagagccaagtgaaagaggaaacccttataaaatcatcagatctcatgaggcttattcactaccacaagaacattataggagaaaccatccccatgattcaattatctcccactgtgttcctcccacaatatgtgggaattatgggagctacagttctaagacgagatttgggtggggacatagccaaaccatatctaccctggcccctcccaaatctcatgtcctcacatttcaaaaccattcatgttgtcccaacagtaccccaaagtcttaactcatttcagcattaactcaaaggtccacagtacaaaatctcatctgagacaaggcaagtcccttccacctatgagcctgtaaaatcaaaagcaagttagttacttcttagatacaatgggggtacaggcattgggtaaatacagccattccaaataagagaaattggccaaaacaaaggggctacaggcccgatgcaaatctgaaatccagtggggcagtcaaatcttaaagctccaatttgatctcctttgactccaggtctcacatccaggtcacgctcatgcaagaggtggacccacagctttgggtatctctgccctgtagctttgcacggtatagccctgctcctggctgctttcatgggctggcgttgagtgtctgtggcttttccaggtgcaaggtgcaagctctcagtggatctaccattctgggttctagaggatggtgggtggccgtcttctcatagctccactaggcagtacctcagtgtggggactctgtgtggggtttcacaccccaaaattcccttctgcactgccctagcagaggctgttcatgagggtcctgcccctgcagcacacctctgtctggacatccaggcatttccatacatcctctgaaatctaggtggaagttcccaaaccccaattcttgacttatttgcacccacaggcccaacaccacatgtaagcctccaaggctcggggctcgaaccctctgaagcaatggcctgaggtctacgttggtctgttgtagccacagctgggatgcagagcaccaagtcccaagactgcacaaagtagcaaggccctgggcctggccaggaagccattttttcctcctaggcctctgggtctgtgatgggaggggctgccatgaagacctctgacatgccctggagacattttccccactgtcttggtgattaacacttggctcctcattacttatgcaaatttctccagccagcttgaatttctcctcagaaaatgggttttccttttctatctcatggttaggttgcaaattttctgcacttttatgctctgcttgctctttaaacctaagttccaattccaaaccatacctttgtgaatgaataaaactgaatgcttttaatagtagccaagtcacatcttgaatgcattgctgattaggaatttctttcaccagatgtcctaaatcatctctctcaagttcaaagttccacagatctctagggcaggggcaaaatgccaccactccttttgctaaaacataacaagagtcacctttgctccagttcccaacaagtttctcatctccatctgagaccacctcaacctggactttattgtccatatcactataagcattttggtgaaaggcattcaacaaatctctaggaagttccaaagtttcctacattttcctgtcttcttctgagccctccaaactgttccaacctctgcctgttatccagttccaaagtcgcgtccacattttcagttatctttacaggagcaccacactcccagtaccaacttactgtattagtctgttttaacactgctgataaagacatacctcagactgggtaatttataaagaaaaagaggtttaatggactcaaagttccacatggctttggaggcctcacaatcatggaggaaggtgaaaggcatgtcttacatggtggcaggcaagagagaatgagagccaagtgaaaagggaaaccccttataaaaatcatcagctcttgtgagacttattcactaccatgagaaaattatgggagaaaccgccccccatgattcaattgtctccaactgggttcctcccacaacatgtgggagttatgggagctaccactcaagatgagatttgggtggggacacagccaaaccataccactccacccctgcccactcccaaatctcatgttttcacatttcaaaaccattacaatcaattattgtgatgcaatcttgaatctatagccaaatttcccacttctcaagatttattggaaaaaattatccctagtgtccctcagaactgtttggttttctttttttaacatttagacctttttcatccatctccaatgaacagcattggagttgtttatctagtagagtatgtatataatttatgacaaagttaatttcaatgatcctcaagtaagcgttttttcagtaccccccatgactattatagtcaactttcttgttctcagaaacacatgaattaatatttcacagatgaagcacaaataatcaataaacttatgaaactgcttagtaacaatatttattaaattagtcaacattaaaaaaaacctcagctgacatgggtatggtgacagataatctctttacccagtgatgtgactgtgaattactttctggaaagcaatttgcctatatgttacaagagcctaataaaagttcatactctttgatctagtaattctactttaggaaatcaaccctatagaattaggttaatattttgacaaagatgttcatttcagaattctttttggtagtgaaatattatttaaaagagtataaacatctctcaatagaaaaattgattaaattatggttatcactgggatattatgcagctattacaattgtgtttttgaagaatttttagtaaaatgaagcagttgttagaatataagaagttaaaaaagcatatatatttttattttaagtaaagacagaaaaatgacttgatggaaatatactactttttcagttatgtccttgggaagtggaattgtggctaatttttattttttgcattatattttttctgtgttttcaatttttgcataattttaatgcatttttattatgattataaagaaagattaaaaacataaatatgattgagttctagattaaacaaaaccagaagaagcattatttacaaaagttgactcaaccaagacttttactctttggatctgttacatgtaacattaccacgttttgctgcccaagccagcattctctttctcattaataactttatgattatgaaatgagttataaaccaattataaaagaaaaccattactgcctgatagacacaaaataacattaaagcagaaatgcatctattcggcactgacaatcttgatggtcaaactgcctggaaaatgaaactcctataatttaaatgtaccaaattaggaaacctcacaagaaacccagacactttgtcatttggcaatatggactgttgcctggttaacacactaaatgattactaaagcttacagaacaaagactgactttacctaaaggagtctgaaagttcagaaactcaagaacatagaaatattaacatctggaagaaactggattgatgctctcaataaagagtggcacaaccttagataaaataacattcatttgatatgagagttgagtatagaataaaaccatactttattctgatgaattccagattacaatttgctagaagaaaacccagagattttatttaagatgactctaaattacgcccaatgatttatataaaaagtattcctactagcaatatttatattgatgaaaattaagagaaaattaaggtttaacaattgagctttttttaacataaattatatttccatagaatcttatgccatcattgaaaaaggtgttgtcacagaatatttaatgaattaggaaaatgttaataacttattaataaaaatatagttatcagattgaaatccatatatatgacatatattcatatatatgtatgcaaaaaccacaattttgcacccaaaaaatatctctaggtaatattgtcataattagttttcactttcttccttattttctttagtttctaatttttttatgacagaaaaggtgacctgaaagtcttcctaatctcctcacctatgaacctgttaaataattacattaataataaagatatcttctttaaaatatgtatttaaaacattgtaactgaggtttaatctcagtaattctgaaatatttatttacgcatgtgggaacaaaatgttattttataactaccagcagattatctgttagtggtagtatattgttatcccatagagagagagagaaaaaaaataaacccttcagcaggacttttgatcacgcaaaggcaaaacttgactggagtggccaggagttgaactgagattagagagagttaaactttcctgtatgatattgcaaacatttgtcttcattcggtgttgaattatgcttctgcagttttgtttaactgagaggtgagcatagagcattggcgagggggatgatggagaaaagtctgttcctcctttctactgggctaatccaggggtggtgagggggttatctcaggggcttaaggacacccagattccacatatgcaaaacataatcaaggacattattagtgggaaagatgttcagaaactgtgtccaccttttgagagcttccaatctactttgaactgcaacatacagaataactaccaacaaggtacggtattcccactgtcaagaaatattaatgagctaagtttgcagaggcctgatattataggaatcacctacaggattaatgtccacttagcagttatggcagaaaaatattcatctcttcttcctcatcaactgacattatctcctgtatcaactgcaaatgcatttagcttcgagtactagcaaaccctactaagagtgagtcaagtattacagacatgtattatgccatggaacagcagggcaacccagcccctggcactggctcagctatttaatgatgtcttcccagattcttcctttctttccaccctgctatccatagcatgctggatttttatccctgggtttgctgcctcatgtttgcaagatggctgccagatcctgacattatatttgcatccaatgccagaataaaaagagaaagagacaagcgcagttgccttttgtaataagaaaacgaacttgctcccaaaactatcatccttatcaccagcaactttctcctagatatggcacatgaccacccctgaccaaatgagtggctgggaaagcatttcatttgctccagttttctgggaggtggtcaggaatagtgaggttggaagtgacggtatccgaatggggtctcccctacttctccttgtggttttggcatttacacaacaatttttcccttatttctagttattcttacagttactccctgtaattgttagaaaacatttctattttgtccactaagtccaggcatataatcatataaaatttggtaacttggaatatttaaacacaatgacaatgacaaaacttactgatggttttgtaaatcagaaagcacaaaagcgcggagaagataacgtcaaaaacatttctttctagtatggtgatggggagattgtggaatggggcattgcctgagtcccataatgttgccaatgttatcttttatctgcttcccctgtttcatttactcaggacactgagagggcatagctgctagagagatgaaccctcttgctggaaacaatgcatacccaagtaatagtttatatcagtgtttttcaagttttttcaatattgtctgcctaaggagacctttcagatattttttcctgattgccttctccataaaattttagtagacagatatacagtcagccctctgtgtttgtgggttccacatctgtggattccaccaactaagaattgaaaatatttaaaaagaaaaactgtgtctgtactgaacatgtacagagtttttccttatcattattacctaaacaatacagtataactatttacatagcatttacatttattgtgtataagttacctagagatgatttatacaggagatgcaggtagataatattcaaatactataccattttatatcagacatttgagcacccatggattttgttatttgcagggaggcctggaaccaatcccccacagataccagggaatgaccgtactgtatacatgtttatgccttggatgtatatctgtactttatacataaaatgaatatgattctcttgtgcccatctccaagccaatttttgctctcttgggaataacattgcccctctgagaatgcatagtctctatcatgaagacttcctctcaaggatggatgaataaagggaattaagaaaaatacctgaaatgattcttgaagaatgaaaataactacatagagagacagaaggaaaaaaacatcagacgttttgggaatgcagaaataaagctgaagacatgtgggattgttatgaaggtatcggggatgaagaagtgaccaacttaggtggggtcacagctttaggtgaggagtaaagagaaagagtcctccagcatggcctttctcagattgtacactcaaggatctcaatgccagcatcaagagtatgaattgtaacaaatgaggaattcactaaagggaagtgaaatcatcaaggaattgtggcttggggttgggggataatttccaatttgactagtttccacatctttatctttatttctcaagacagctgcttccaggttacaataaaagagagtctacctaaagaatctttactagttcagtaagaatctctctaaattcctattgcacaagaggaatctaactcccacagataaacaatgactgaaagcagcacttgaagactaatcgcgtaataaaaaaagactgggtcggccgggcacgttggatcacgcctgtaatcccagcacttcgggaggccaaggtgggtgggtcagctgaggtcaggagttcgagaccagcctggtcaacatggtgaaaccctgtctctactaaaaatacaaaaattaggtgggggtggtggtgggtgcctgtaattccagctactcgggaggctgaagcaggagaattgctggaatgcgggaggcggaggttgcagtgagccgagattgtgccatcgcactccagcctgggcaacagagtgagactccatctcaaaaaacaaaacaaaacgaaaaaaatgactgagtcagggaaaaactatatgaattatcaaatggcaaactctccctcaagcttcttcctacaaggaaaacacctagaagcttcagcatgaattaaagttgtgttgtgttttacttttcttccaaaatggtcataattaattttgttgacacaaatacacaagatgttaaagactaatggcaccatgttggtgagaagacaaacccattcttgcttaatacactggagaaagatgctcagatcattcaaccatgtgaaagcaacctttcttgtactgcaaagtcagcaagacctctgctaaaaacaaactaaaaagctattgcataaatgcaaatacatacattagggtcacattatgtatctaatttaaccaatatttcagacaaaattgtgtaataaaaatgaatgtgaatcttgtaaagacctctttcaattgccctctccagtgttccttcatcacccttagaataactccaactttgagacacacacatacacacaaacacaggatggaataatttctagaggtgtacattaaaaataaaagttaaatctgtcttggggatcaatgaattaacagagatagataaactccttttgtcttagccataatagatcaataaagtaaaagaaagacattttggtagatttttctcactgaatttattgacttttttaatgttatgaagaaatgtagagattatactgtgggattagttgatccttttttcttgagtctgggaaacaaatctgtgtaagaactgtgtcatgcaaaactcagaagcacctagatcttcctttctgaatagacaaggaattgttaaatgagacgcagtctctttttaccccatgatcaaaatgtaagacttgtaaatggggtctcaagttaaaatttcttaagtttaaaaggggattccctaaattcaatttagtatcctggaatgaatcccagagaaagggcattagtggaaaactggggaaatctgaatagacttccgaaaagcaggttgctgctttgagtattctttttctttgagttttgctaatttgatcataatgtgcctcaataaagtctgtagtttagttaataaaaatgtatcattgttaatgtcttagttctgataaatgttccatggttatgcaagatgttaccattataagggaaatgatgaaaagtatgtgggagcctgtggaataggctttttctgtaaatctaaaatattctaaaataaaaatttgctttaaagaaagctctctctccagttcactcgtcttagagaatactcatggtattcattggagtaaaccgtgttttatgatcaccctaacacattaggggttattttgttctttttgtatatagaaacatttagtaagtatttactggattccattgtgcaaagagcatagcaaagatgtcctggatttaagagttggaatctttgcatttagattcattatgagccgtgagatcctgtgcaagtcatttaaacctttagcagctatgcctctccactttaattccttttgggataggaaccccatttcactcatcccggtagccttcagtaaccttttttggaggaaatatgggacaagtgacagcttcagagtcaaacttagtttaaaattccagctgccccactaaccatgcatgttactatgggccacagtgtttaacatttttgagtttcagtttttttcatctgtaaacttttgagatgatgaaatgagatgatacacgtagaacacccaacagtgtctagcacaaaccggaagattagcgtgcttcctctatagaacagcacctttcccatggaattttacttatttttaatctcgaaacacttttctagtactcaccatgtggaagaccctgtgctaaatgtttttcaaatagcaactcatttgattatcttaacaatcttatgaaggttttatcatcccattttacagatgagatgaggaaattgaggcataaagaagttaccttatatgccaagatctaacaactactaagtggcaggacctagaatctgtacacacacagtactcctccagggttcgtattccccaaatgctaaactttcatagatcatattctaccaaagagatgcataggcccacgaggggcttgccttgtttactgtagtctgccaacagtgccagcacagagtaggtgttcacacacactctgactaaacgaatgaatgcatagcagtccctgtatagacatgtgctgattcaaatatcggccaacccatttccctgcatctccagcatcgcagcagaaaggaactagccttctccatgagcctatgttttagttcctgtgtttgaaacactagactctcattcaaatctcaaaccatcctataaggggcatgggaatacagcaggtgccccagaacaatgtttcagtcaatgaactgaatacacaacagtggtcctacgagatcacaatggagctgaaatagtcctgtcacctagtgacattgtagccattctgctgctgtagcattactcacttgtttgcggtgatgctggtgtaaacaaatgtactgagctgccacttgtataaaagtctagcacatataatacgtacagtacataatgcttgtcaatgataataaatagctatgttactggtttatgtatttactatactttttatcattattttcgagtgtcctccttctacttgtaaaaaaaaaaaaaaaaaagaaaaagaaagaaaagttaactgaaacagcctcaggcaggcccttcaggagttattccagaagaaagcattgtcctcataggagatgacagttccatacatgttactgctcctgaaggccttccagtgggacaagatgtagaaatggaagacagtgatattgatgatcctgaccctgtgtaggcctaggctaatgtgtgtgtgtgtgtgtgtgtgtgtgtgtgtgtgtgtgtgtgtcctagtttttaataaaaagtttaaaaaacaaaaagaaaaattttttaaatagaaaaaagcttataaaataaagatataaagacagaaaatatttttgtacagctgtacaatgtgtgttttaagctgtgttattacaaaagagttgtaaagttaaaaaaattaaaaaatttatatagtaaaaagttacagtaagttaaggaaattattgaagaaagaaaattaaaaaaattaatatagtgtagcctaagtgtacagtatatgagagtctacagtagtgtacagtgacgtcctaggctgttcacattcactcaccactcactcccgactcacccagagcaacttctagtcctgcaagttatgtatatggttaagtgccttctacgggtgtgacttttttttatcttttataccatggttttactgtacctttactatgtctagatatgttcagatacacaaatacttaccgttgtgttaaaattgcctacagtattctgtataggcacatgctgtacaggcttgtagcctgggagcaataggctacaccatattgcttaggtgtgtagtaggctatattcttcaggtttgtgtaagtgcaatctatgatgttcttacaatgacagaattacctaaggatgcatttctcagaacatattcccgccattaagtggcacaggactgtatttccctcttcttcctggagaaatcagaacacagaaagaaagcacttaacctccccaagtcacgtaattaatcagaaatgcagccagcatcagatccccaggattcctgcttccaaagcacaggccttttgtagtctaactggatgcctcccagggagataaatactgggaatatgtttgtcgttgaagcggttctttccttcgcttgatccaggtctctgcttctataccgtctcagagcgacttgctccaacctctggaataaactgctacattcacttggtatcccccccctttttttttttttttgagatggagtctcgctctaccgcccaggctggagtgcagtgatgcgatctcggctcattgcaagctccgcctcccgggttcacgccattctcctgcctcagcctccaaggtagctgggactacaggagcccgccaccacgcccggctaatttttttgtatttttagtagagacggcgtttcaccgtgttagccaggatggtctctatctcctgacctcgtgatccacctgcctcggcctcccaggtatccttttactctactttattcttttccttactgcagccgtcattatttggcatcacattgtatttgttttccgcctgtgcccctgtctaactggcaagttccaacaaggcagagaatgtgtctgtcttggtgatcattgtatcttagggcctataataatacccaaaacaagcaaagcattaaaaatgtatattaccccataaataaatagatatgcaggccattccagcaatagtttagtagtattacccttattaagattaccagtatctctttttatcacttaggtcagttgggacaaagctttatttaataagataaaactgacaggaaaattgagtaaacagtgttggtttcaaatcagaccaaagcatacagtccaagcaacaccattaacaactaggaaaccaaacacttggggtaaggatgtctttcagacaagcggaatagccagtaccagtgagttaccaaacacagccccagttttcattccttctaaatcttcatgagcttagaaatactcctctgctgcagatctcaaattgttttaattcacctctcatttttccatcaggaaacaattggccttgatttattttgtatcactttatttatgcatctcctgtaagactgaaacattgattttcctaagagataatgttaataggatcaatataccacaacaggcatgtatcaaagtgccatttctttaccctaagctgggtgaaggcacgaggcactgggggcaggcagcctctgctgaaatccacccagctctggtgatttggaaggtggtataaaggcacctttgctaataaattatgaatgagctcaagcactttgatgacccagataagatgccaaagagcaccactgaggactctagggagtctggaaacctagatcatattttaaagctatctttaaacacagtccacactagggccagaatatttgagagagggagtcagggcaggggtcacacaaaggactagctctttgttggaattttattctgagtgattggggttaactggaacaagccatttcccaggtggtctcctctttcatctacttttggaagcttcaaattccagtgtttgacacaggcagcaaaagagaaccagtgaccactgcttaatggtaaagctaagtgagttttgcaggcaggttttattttaccaacataaatgtggtctcatttcttcctgtctgtagactctaatgcaacccagacagacagttctgtgctggaaacccacaggccgaagcctcccttccctctcctgacacctacagggtctctctgctgtaacaaagcactgagtctttaactctgcaggggaaggtgcttagcagaatcatgtagggaactcttctaaaagcacacttgctggagcaaatgatcatcctctcacctaagctgagaatcactcagactctcacttgtggttctaactctagaaattcattagaatcagctgaagaacttttgaacactagattccccatcccacttcagacttactggtaaagagattgagggaaggggatgggaataagggaaagagagtctctatttttaaaatgctcccaggggaatttaataggctcctttagctaacatatttgacaaccatttctccaaaattccaatggctctcaaccatggctgcacattacctgaattatctgtgaagattttaaacaatattgatgtccatgtcccattgtagaccagggtttctgtgtgttgggggtctatcccaggcccctacctgacggatggcctagcaacctcctctcctaagcaaaaatgtccccaagcattgccaaatgttccctagaatacaaaattgcctgccctcccccacccctaatggtggtgcctagtcatacgttttcaagctcattttaatgtacatcatctccattacttcatcttcattacatccatccatgccctttcaatctctggtcactttgggtgatacacatatctttactctacatgggcagagtgtattataggaagataccaaatccacatcctgaagtagagtccagctggtctgtatgtgttacattacatgttcatggcccaaacttgcatttacatagacttaaagaaacagttcacaaaagggaagggacaactaattataaattaataatgagggtagtaatttttaaaaaggcaaattaaaagaaccaagcacagtttttatttctctaacacatttgcaaaatggattcatttgttaaatatcctgtgagtatctataacgtgccacgcagtaagcaatacagacaacattgttgccattattactgttgcttcttatattttagaaggggagagacaaatgccatgcaagcttacacataaaataatttcatattgtctaaagtgctactgaagaaacaaaagaggtgatgtggtggagaatttgaagcagcagtgagctactttagagcgtcatagaaggatggaataaaagcgacatttgagcctaaacctggtgctgtcacccactgctgatgacatgaaaattggctatgtcttctaagaaaatattttgccaatatattttagaggttataatattattttatccaatcatttaacaaatttgggacatctctgaaaatatgctccatcaataccactgctgagactgtatactaacgaaattactataatagagtaaaataacccaatacattagaagctttacaatattttataaaatcacaacctaatgaactgtcaatgaaaggggacagttagataaattctggcatatcaactaaaatgtgaaggatgcttaagggataatgtaaaaaggttatataatgtgtagaatgcttaagatataatctaatgaaaaataagcaggttacaaatttgtccacacatggattgtatgtaggacttgatgtgtaaaaaaattgagaagaaaattctaagaaagtaataagagcgattgtgcagcaggtgccttttatggagaattttttttcctctcctgttttcagacttttctgattcattctttagacaaattattaaaatgatgcttcagactttttgttttttgagacagactctcactctgttgcccagactggagtgcagtgttgtgatcttgattcagtgcagcctccacctcccgggttgtagtgattctcctgcctcagcctctggaatagctaagactataggcacatgccaccatgccaggctaatttttgtatttttagtagagacagggtttcaccacattggccaggctgatcttgaactcctgaccttaagtgatccatccgccttggcctcccaaagtgttgggattacaggcatgagccaccacacctggcataataatgcttcagaaaaaaaaaaaattatttcagttcaaaggataaatatcttaaaaaaaagaaataaatacctttaaaaagataaatacatatcttaaaaaaataagaaatcagttgataaagatttttctatcaaatatttgcataatcagcagttatttttactccaaaataagcagtatgagtcaaaaactttgcagctgggaagcccattaaaatctttggttgaatttcagcagtatcaaattatttttccaatgtctatataaacaccataggtgcattgcattttcaaaggaataatttggcaaataatctgttataatttccttacattgacaacttgcttttgaatatgttctaactctgacataaactttcatatattacgtgcactatcatattttccaagtgtgtaactcaattcaaatactgatgtctttggtctaaaaactttaaaacattctagatccttgcatttcaaagtttggtctatgaataaaaagtctaggcattgcttgagattgttaaaaatgcagattttcaggccccacccttacatactgaatcactattaatgagatctccaaatgatttgtatgctccttaacatttgaggagcactgctctagaatacgggtttcaggattaaatgatttgttcactctctccatcatttgtatttatctgaagggatgaaaagattagaattttccacagctgaactagtgcttttgaaaagttctctatgatctttgctttcagtcaaatggagaataatgacaaccaggcatgatcactttgaatttaggaggtgtctctattttagtttttctggtctatctgtaacttggagacagtgtaccagattagggggatggatggtgtacagaaatccagtgtctgttaaataaatgacaaagtcaataaagaagtaggtgaaggtacaaataaagaatgcttcagaatctttctgaaataatttaaagccaacctaaaaattatagtccaattttagaacaaaaacaggcctgagtttcagggataaaaatgaaggtggttgatagatccacttttctttaacctgagattagtcaaatgcttttttaaaaaggttttgtgttctattagtaattataaataaatattcaaatagatctgaacaaagaactccagggcacgtaaagacaaaatattgactcttccttttttcttacctccaggcactgatttcacagaagaattcaattgtattcatggctcatgaacaaacataatgataaaaatgctctgtggatataaaaacatttcttcccaggggctcaaacttcattctagacattatctcattaattgcttccttaaatctttctcattgatttttatattttttgaactagcaagttcactatttttttttttttgcatatgaaggaaagagttcacttcaattagaatttgagatcttaagcatcttttaaaatggcgatgttacttctcaactgacaaggagttactggagtagtttcaagaaaaaccaaagtgaccgaacagcattatttatttatgcatgaactagcaaaagttctgagggtgtcttgggaagattgtatcaggaatgtaaatacttgactaatgtaccttggcagtatcaaccagcagagatatgtttgaagattagagatgtgcaaatgtctcatttgtgaaagggaaacaaaatgctagtatatattattaaataaggcttctgacaaaataatgcagtgattgctacggaccagtagggattcaccaagaacaaggtcattcccaatcaaccatattcctgattttgacagaattaccacttgggtaaaagaagggaatacacagatgtcataaaattcagctaataatgatcactattcttccttgagcacttccaatgggccagaaactatagggagcattttatagacatctcatttaatcctttaaaacttatgaggaagtagcattactaatttacatatgagggaaaagcagctagtccaaggtcacaaggctgtttccaaggataatgttttgagacagccaggtgggaaggggttcccagagaaactccaagtagcctgcgcactgagatgagtgcccactggggtggagccacagaagttcatgccccttgcagcagggaggagcttggcctctcctcttcctgggtggaacccaggattcaatctgcgaagcaggaaggatgtactagcaggactctcgctctgccctgtttccccttttttgcccaatcaatcccatttttctcactcttcaaatcatctgcaagcctaaattttcgtggccatgtgacaaggaccccatctttagctgcactaaagttccacagcagtttctatgcatcacaggatgctcttttccacaaacctaatttgcctgtgaaactgtgtggttaatcggtcagatcactccatctgagcaatttaaacgtcgtccataatttctgttatagtatttctgcattataatgcctatttgtttgtctggctctctttccacaccaagagcttttcttcccttgatttcctttgcctagtccagggcttgccctcaggtagtgttcaaaccactgttaggagacaatcaagagggagcctattgaggccaatgctagggatgagaatggggaagtaagacagtgcccaccagagcctggggccctcaacccccaatttaggaggtactttgaactctttggctctatgattatacataagtatacttttttgtttgtttgtttttttttttttttggtctttctcaaaaaaaaaaaaaaagtgattggatcatgggggcagcttcccctatgctattcttgtgatagtgagtgagtgcttacgagatctggtgctttaaaagtgtttggcagtttcctctgtgtgctgtctctctctctcctgccaccatgtaagatgtgccttgcttccccttcaacttctgccatgattgtaagtttcttgaggctccccagccatgtggaactgtgagtcaatcaaacctctttcctttataaattacccagtctcaggcagttcttatagcagtgtgaaaatggactaatatatcctttaaagtagtattgtttacattttaaaacatatagtgattgaaagaacaaggtgttaaagagatggtccagtggagtggttaaaagtgtgagttctgaagatgcccaatgtgggttcaattgcaagtgatgacctttaatagcttttgatctgggcaagttactaaacttcttggggcctgtttctattatctataacccttcttcacagggttattttgagcattagatatgttaggtcatgtaaaactgttcctggtacataataagtgttatatgtaaactgttattagcatctttaggtacagagatggggagatttctaaaaaaattattaagtgagaagaagtgaatggaagaataatatatatgggatggtcacttttacatattaaaaactatttttattgaataaatgcaaagatagaggaaagatgcaccagtctttgttgctaacctattagaaggggaagactgtggggaaagaggagaaatgaataaagggaattttcatgtgttcaatatgcttatttctacattattctaattgttacaatgattacatactcaatatacatatttattctattaaaatattaaattaatattgagggaaaagcaggtagctttgataatatgctacctgcacccccataattaagaagcaatgagataatacatgcaaagggtctagaacaccatctgccagttgcccaacaaatgtatatgccctggccttctgattttcttttcttttttttttttttgagacagagtcttgctctgttgcccaggctggagtgcagtgacatgatctcagctcactgcaagctctgcctcctgggttcatgccattctcctgcctcagcctcccgagtagctgggactacaggagcccgccaccacgcccggctaattttttgtatttttaatagaggcggggttttaccatgttagccaggatggtctcaatctcctgacctcgtgatccacctgcctcagcttcccaaagtgctgggattacaggcgtgagccaccacgcccggccctggccttctgattttcaaaggcacagcacaaaaaaaacaaaaacaaaaacaaaaacaaaaaaacttggtcccatgcctcagtttggtcactaggtagttttggtcttagtcttttgagaggagaacaccaagtccatggtttttttcatactccgatgactggcactgatcaatgttaagaagaacgacctttcactcctgaattttctcattgactcaggcaagaagggtccgatgcaatttcttcatttactaatggatatgagaagatttatgtggagtccttattagggaaaaggagtcaggctggcggcaccaagggaaagcaactagagaaagcagatgagctgtaggtctgcctttgtggcccaggacatatagccctcccaagcaaataacatacattaggggtccccagcccccaggccacagaccagtaccagtccctggcctgttaggaacctggccacacagcaggagatgaacagcaggcaagagagcattaaagcacctcctcctgtcagatcagaggcagcattagattctcataggagcacaaaccctattgtgaactgtgcatgtgatgatctgaggtagaagtattatcttgaaaccatgctcccccaacccccaacccccaacccccacccctacttctccatccatggaaaaattttcttccacaaaaccagtccctggtgccaaaaaaggttggggaccactgacgtacgtaactcacaaacttcctgcttatcatcaaacacttcaatttgtcatcaaacacctcagctgagagagaatacaagttagctccctgctgccttggtggtatcaatcagcccagaaccatcctaaaaaatctccaggaagcctttgtttccttgcagtcagatccttctttgcccattctgcctgttattcccctgcaacatattttcatactttctctaataaatctgcctttctttacctacaactgtcttggtaaattcttttacccctgcaccaagtgcctggaaagtcaccggtcaccaactggtcaatgcctattgactataaactgtcacaggagatgtttcaaatgaactgttttcctgaaagtgctttggaaatctgaagcattaagtaaaaaaatacatatttaataatagtgacaacactaatgatatattatcaattaatttttttctgtatagagccagaatttttttctgtatatagccagataatgaatattttcgtctttacagccatgcagtctctgccataactactcaattctgccatagtagcatgaaagcggttgtgtacagtacatcaagcagtgagtgtggctgtattttgcacaggctattttatttccaaaaatgtagtccatggtttggatttggcccatgaactacatagtttgccaacccctgacaatccactgaggggagacactgagaacttgtttttgacatgggattcatgagatctgtatactttttatgtttccatagacagagagattccttaatcaagtctgcttcattagctctgagataatagtgcatctgtcttgccattccctccaaaagaagaaagaaaaaaaaaggaataaaaccccaaattgtgatgcggaacaagggaacatgcacactaatttagactgcataaaaccaaattaaggttgtttttctgattgaaattagaaacagttgaaaactcatgttagtaatttggagttggcagctctaagtatgtttatttttaacatcattacttatttgtgaagggaaagatacataaaacttgttgtctcaattaattaaaagaaataagctcccagaaagaaaaaaaaaatatatagagttttagtgaagctctttagtctgtgttgacatacactaatattttaactatgcgactgaattaattgaatattggatattgagccaaattagtccaaaaagttaagtcacttaaactttttagaattcaacacgtcaaagatttgaaccttataaagacttcagtgcagattttaacatagatcttttaaacatatatcttcaagttggaattccatctgtctctatcattgttcttccttaggtgtacttgatttttgtgtttgtgtgacaaagccagttaatgcacttggttgaaattccaaattttggtttagatcagtgaaataaccattttgcattccctaatgtgcaagttttaacatataggacaaaaattgagctgcagtactcattctatttcattgatattgatagaccgcctcatataatttaattttaaggagttccacatttgtttggctgtagtttaaactctgactccccattctactactcttcacagccttccacgagcaggcagtagctcttccaattcttttacccacttccctgcaccatgctcagtgatgcagcccatcattgctttctagacaccatgttgtctgacctttttgcccttcttctcctcctgtgtttatccaaatcctaagcatccttcaatttcaactcaaattctccccctaagaaaccttcctggatgacctcagcccaaagtgattattccctcagataaattcctaaagcatttactctcgtcataagtgacttgtcacataagagatatcacctttggttggtagtgacagtgtctcatctctaaactcctagaaggcagggacaattctttaaaattgtgttcttaggatctagtatatttcctgcatcgtatagtcattctttcaataataatttgttggaaggacagctggatggataaacaaacaatctataccaaccagactgtaagaggctggcaggaaagggccatgactgacaacaaatacttagtgatttatttgagctttacacttattaaatgatagttccatctcatggttttaaattctaaaaatgagcttaagacatatatacagaatatcaatgaaatgagacttccaaatgaaaattccaagatttcgataatctatatgtttaaaatcactgtattatagaatgagattttttaaaaagatgttcaacccaacactcttaacttcatagaacaccagcacatttccaactgaaaaccattaaagatgaagaagttatattacacaaagttttaggaataattattacaattttaaaaaagaaagtactcaaatctacaaatgaaaactggagtaggtgaaaactggagtaggtgataatgaaattatcctttccagataatttcagcaagagaagttgctgttaaggaggaattgtgagcagtgatgaggaaatggcacggtgagatgaagagtgtaccatgaccaatggttcacattaaacaatcatcacactgtgttctactttattttttccctcatcaatggttcagaagtttacttgtcacttggatgaatatggtgggggaaaaactattggtaaacgtaacattgtggaatagaattttttcttttccaaaaggagttgttttttgaccaggagaaatgaattcaattcccacgttttcatttaattttacaactggtcagagacatttttaacatgtttccatttcttattccttatcaaaatggattaaagaatcagaaaacaggaagttccaccccacactaaaataacctgtgatttactgatttgctttttgctgaagctttcaaagaaccacacaatcacatcatggtctatcagatgcctcagatgttccctatactataaaccaccatattccttcagctttctactttagtagaacattctctgtgctgcaaaaatgcatacatgaacataaagacagataattacaacattagcacaaatgtaaggttaagaatctgaaagacggccaggcatggtggttcatgcctgtaatcccagcactttgggaggcagaggtgggcggatcacaaggtcaggagatggagactatcctggccaatatggtgaaaccctgtctctactaaaaatacaaaaaattagccaggcatggtagtgcacgcctgtagttccacctgcttgggaggctgaggcaggagaatggcatgaacctgggaggcggaggttgcagtgagccgagatggcatcactgcactccggcctgggtgacagagcgagactctgtctcaaaaaaaaaaaaaaaaaaaaaaaagatagataaggtagtcaagtcaagattatcttacattggagtaatgtttttttttcctattcggaggctgtataataaatatacaaaacatgtgcccttgtttctggaaaaaaaaatcaaaattacaatatcctgtatcctgcagagagaatataatctggggtgggaggtatatacttgagtccactaccattctttagacagaaaggcagaatttcttaacaattttatccttcctctgctaactgaaatgcagggtagcccagaaacaactggaattcatttaatttgtaagcaggttttgagctctgctgaagctcctctgtcttcatcttaatgtactttcccccaaagaacaaaaaggagagaaagttacaggcctgagaaggaaaatgcagcaagttggggatgggttggctggcacagcaataattaataattaaataatttaaacatgctctccaaagctgagcatctgacaggctgctgcactccatcagcacggaggcagatatgagccaaggaagacattctaggaagttgaaagagtccctctgggaaaattctgatcaaacgaatgattaagagggacttccaagggtcaaactgaagtcctttgttgtttttactttcaaaaatcgcccaattcagacatttttgttagagtgtacattagcaattaaatatgtatttgcctagctgagtagaaatgttaattctctcttaacctcctaaactcagctttcgggcaggtttaaatcataggatgtcagtaaatataagtgtaagtttcatatacgtgtcatgaatgagtgtgcccacactgtcataccttccctagcagccagaataggtttggaatagagaatgtgctcacagtgaatggaaacatatgtataggcacatatacattcatataatacattcccaaagaagctgtaaaactgaaaggaacataagataaaagtagtttggtctaattccccacattttgcagaataggaaattgagggccagagaagctaacacatacacacacaaaaatgtgtgcaaaatcgaacacatggatagaagaaaagggaaaatttgaagtcaggctttctataataacaccaaaattagtgcactttcactgctttgtacttcacagtgataaggacttgaaaacgtcactgatataccagatgcctaaattcttctcttcactctagtcagcggattttggcttcatcacatcctaattctccaaaatcaaggtcagatggtgaagaccaaaaactctgcagccttcatacagctcaaagcatagactcttgaatcctaagtccaagtctgccattttgactgcccagtcctgtctgaatcacttaagcatcagtacacttgaagtcctaaaagcatattagattctattatcattagcatcactgtcagagcaccagaagcattaatttgtgttgttagaccatgagttttgtgttttattgtatttgctaatttggctttttattgtacacctagcaccagatgcagttggcaaggcatgtgtgtgtgcagatatggaataaaaaatgattattaagtgagagagaactttacagcccaatgagggttcaaaggaaatagtgtccctaagggccaggatttgtagcatgggggtttcgtgggaaagtaaccaggtggtagacatggacaatgattcgggacagtcaagcacatgataggtatgaagcccacagcatccctatcaggcaggcatggtgaatatgacagatctatcctgtcttgctggggaactgtaccctgctcacactgaccataaaattttcaggaaaggatgggacaaggattaaggctggtaaaggaggaggggccagtggtgcaggatttcatgtgacatatcatgaaattagacatcttctctttttgtagctgtcagggagaagccactgaatggattcatcagggagcagcatgatcctaaaaagctcattccggcagctgcttagaagttggagcctaggaaggagttgagacagggacacctaaatgaaaaacatcaggccaagtatcttgatccaatctgcctcttcaacaagatcagaaatgcctcgagtccagggcctatgtcacactcaacatgccaaacatttgcatacagcaggtgctcactatacagtttgttaaatgaatcagcattgcactgtatttggggtgactgtctagaaggaatatattactgcattaggtcatagaggctaaaaacttcaataccctcttttaaactataaataagatattgaagcattataagggggaaaaaacaagggccaaggcaaggtgaagcacagctataagcgacagtccttaaacattgtgcaagggaggaggcaccaaatttcttccagcaaggaaagaaacaatcagttttacttagaaaagaaagctagtcctacagctcattgactgggtgactcaaatgaagttgaggcttgaccttcatgatgatgagaagctgaacaatcattgctcctgtcagtctagccatcaagatggtctaggaggtctcatacactctgcaggttgtcttcactgcatcagatatgtcatctgagtgaccgtggctcagcctgggacaggtgggggaacctctagctactggtttttaagccagcgcctagccagtaccaggacaaaactaatttacagggatgggaaaataatactagcagaagttactctttcctgaatgcttatcacctccaaggcactatgcttaacatttcactggcattatctcactgaagcctcaaaaaacccctatgagttagggacattattactcccagtttacaaatgggacaactaatgctcaaagaagtaatttgtcaaaggtcacacaacaagaagtggcagaactaaaacttaaatccatgacgagctatccatcccctgaagcctaatctctttaattatgatgataggttggtcttagcaaataataatgatgctcttcattctgacagcacttgcagaacccagaagtaatcttgtaatttggacaaaggatagactatggttattccttgacaagttacaggacttatactagataatatgacatagtttttagcaaaagaaggactggcaggattaatcatttgtttgggttcaaatcatggttatattatttcctggttaggtgaccataaaaaaaattgcttaccctcttctaagcctcactttactcacttaaaaaatggaaatactgtggtgctacttcatagagtggctcagagggttacatgtgacaatgcacgcacacactgaaaacacctaccacatactacttactcacatgttggagtaagtggtagaattgtccccacttagctgttagtaaagtgtagggtcaaataaattatatcacttcacttcaattccatccaatccaatttatttcagtgaccgattcttggctacccagtaggtaatcatgttcttggtacacatatcttgattcctactcctaggtggttttcattacaaagttttgtagaatttagtgacagatctagttgctctatcactaaaccccaagtcttgcattgaggtgagcagctcatgacattaacaccttatgtatctcagagtggcatttactgttttccaaatgcacttcttcctttctgctgtttctctccaccattgtcctctcctcaaaccatgttggtctttccttcctttctcttctatctttgggatctgtgccttagggcatcactggcattcaggaatccacagggcgttgcaaaaccctgctcaaagcccctaaaacaagaaatcagtgacccttggaattctcatttcaacgagtgtgggttttgaaagccccaagatgaaaaaagctgtaagatggccatccctgtgggaaggggagtggatcgcaactgagaaatgagtcagagccagcgctggagagtctctggcctgatagctagggatgaaatgcaacattaaaaaccatcacagagatctatagctgagctcttcagtggcctgctgctagctaaaaggcttccacttgactgctctggtttgtgcaagtttgtttaagatgcataattcataaagggtacatagcaccacccttgaataacttttcactccctacctgctcagaggattagctggattgacaatgtcaggagatcactcttgaaatctgacatttcaccctttatggcctgggaatggccatcagctactcatctctttactccgtgcttgtccccatcaaatacctgtatgtattccctggcagataaagttctatcctccctgcacgtagttccaaatagagtctcaaacaataagtgcatctcagaatcaaaccacattttagtccaccaccattatatcaggaagcaggaactaacttcctctgactctctgtttattgcataaaaaagtgagggagattaaaaaggtagggcataaattcagccctgctcctaagcacttctgttccagctgacacaagcaagaaaacgatctccttaggatccatgagattgccccagattatttgtcatcccaatacctgctgatgacataatagtcaatttaaaggtcatttatggtgctcctgctaggactgataaggatcgactgcacaataggggttattcgggggaggcattgttagtactctaacctgccccaaatatccctttcttagcacacttcgatgacatttttttcagtgtgacaataacagcctctttaagacaatccatcaaactaagctagaagacaaacataacttcatgctctgaaaaactttatgttctggttcagccaacagtcattactaccaaccagtatcctgactgtagtttaatctgatcagtgtatttcaacctagaaacaggcccagtcctcacttcttagtctaaagtaaaaaggggtaaaaatgaaaatgtaggattagctatggcttatgatcacccactatgcatctaaggaactcagcacattatccatctagattactccttaaaataatcctaaatggtagattctcttattatccccattttacctcaatttttttatctgtataaaaaattaaaataatagtaccagtagcaaaataacattgccaattacgacaataacaacagccaccatatactaagtgtttgctatgagctggacactgtgaaaagtctcttatcttcattgtttctttctttctttcttttttttttttttgagacaaagtttcgctcgtcacccaggctggagtgcaatggcttgatctcagctccctgtgacttctgcctcccaggttcaagcaattctcctgcctcagtctcctgagtagctgggattacaggcacctgccaccatgcccggtgagtttttgtatttttagtagaggcagggtttcaccatgttggccaggctggtcttgaactcctgacctcaggtgatccacccacctcggcttcccaaagtgctgggattataggtgtgagccactgcgcccggcccgttgtttctttaaccctgacaaacctatgacatggacatcattatcatcgtcttcattccttcagacaagaaaattaagagttcgaaaagttatgcaacttgctgaagagcacacagctagtaagttgcagaaaggactgaaagaccctgtctattaaaaccagacatttgcctgcctagaatggctctcaggaaaactcattaccaaagtgtgaagggcagaaaccacactgaaggaaattctgtatcaaatgcagattttagttactaaaaaagacaaaaggtgctgaactgcttacaacctatttggctgcttgctttatttaattaattccgctaaactctatggatttaaccaatagtagtagcctggcagctttaacgcctccatgaaccttcattaacagcagttgacccttgccaaaaggtggagtttggagcatttgatgggttacaatcttaaatgggaactgattgagcctccttaaaggaattttaaaagccaagtgtgtgtgtaggtacacacacaccttttccaagagttaggtaaggagggtgttgtgctgaacccctattagcctcaataaggaagataccaagttcacaaggctgaggaagagacccacagcccgcaagggagacatgggctttcgtttggggactccatgcagggagtggcagtgggctggacaggagaaccgccttccctacagtccagaggtggcaggctaggcaggaaaacagtaaccactaacaaacggcatgcagtttatatagcattttaccttaacttccctttaatgagcgccacctgagggggtcgctcagctgttctttatagacaaggaataactctccgtgttggccatgcccaggattcactagctggaaacacacattcaggtgcatctgccatacaaggtcattctcagagggtgaagttattgctgtcaggtgtgcttatcctagggtaggtttccgtagctaatttgaatacattttctttatgcatagctgccacttattgatgagttactcattggcagccactgaatttagaaatactctatatacattgttgtatttaaccctcaagacagccctagaagacagatgaccttattacttgcaaatttacctgttttgggggctcttcaagttttttttctaaaaattgtcaaaggttataaaggcacctctaaaaattatattgcttgtatgagctgagcacatggacccttgattgctctccagcctcccagatggctgtggctcttgaaaagggtttactgagagtaggctgatggggagaataattagacaagaaccagcagtttcagacagacacatcttttggctggtgcccaaaccaacagttgttttcactgaatgaaatcacttagaaaacacttgatacctgaatttagtcaatcctatttgggggcatgtccccagtctcaacccttgctgacacagcctgctccattttcagaatactgtggggactttgaggcctctggccctaagttaaaccttatttcaggcattggaacttcacaaaccattcattctcctatctttggttttctcatctgtgcagtgggatgattattatagtcataataacagacactttgtgtgcttagtaagtgctggttctaagtgctttacgtgcattgccttttatactgctcaaaggctttacatttattgcctaatttaaatgtcacaacagacctatgaaggaggatctaaaccaggtggactgaatctaaatttcaccattgtgttcactacctatccctggagttctccagccaaagtgtgtatcagaatcacgtggagggctgatgtctcagtaactatgcattgatctgacccaaggccatggcagcatatgtaaggatggcaataaagtttaagagtttgcaaataaggacagcagtttatccaaatcacagaaataaacatgacttcaaaaagcagacaggtgagtatttaaagctgtggctgaacctaatgtacaaaaatagacctaaacgaatgcttctcgtactacatcttaccagcaaactctggctgaaatacatattcatgaatctgttggtctggaatatctcagactgaactagcaaatttggcatatgtccagtgttcttatattcagcacaggtttatttttgccccgaggaataaatatgatttttgacactaagcttcgccactaataattgggatattaacctaattctattaggatagcttttcgactgagagggggttagtgacatttcatgtgtgaatcatgagtaattatgtcatttatataaagactaccctctcacctcatctcacctgcagcctaaagagcagatttctgactggaacacttcccacagctatgaatcctaatccttgtaacacgaacactaactcatgagttacacatgtgaaagcattgagtgctttcacagtggcaggcactgtcctgagtgccttacatctcatctcctcctaactagaaatattaagaaagtagtcgctgtgatgattaatttctatttcacagatcataaaattgtgaaatagaattgatacacagctaataaatgtctgaactagattctgatgcagagactgaaagattctagaatgcatgattttaactacttcactggcttccatttgtgttttcattgtcctgttgtttatatcttaactagaaataacggtaaaagtaaacattggctgggcgcaatggctcaggcatgtaatcccagcgttttgggaggccgaggtgggcagatcatttgaggttaggagctcgagaccagtttggccaacatggcaaaaccacgtctctactagaaatacaaaaaaattagctgggcgtggtagcacatgcctgtaatctctgtacttgtgaagctgtggcaggagaatcgcttgaacctccaaggtggaggttgcagtgagattgcaccactgcactccagcctgggcaacagagcgagacaccgtctcaagaaaaaaaaaaaagttaacatttgttgcactctttttatgtgcttcctcccaatgtgccaggcagtttctcagttaatattttatcaatatccccattttccaggtgagggatctaaggttttcaggggttaaacagctagaaagcagtagagctggcattctaactgcttgaataatacatactgggagttaaaattcaaaggtcatccaacgtgaggcagtattcctatcctcttgacaggggcactattattagaaatggaacaatgttggaggttcaatggtcggcaatgcataaaacccacatttttgccctttccgtaggttaaagcactttatgaaattttccccccagttttatggctttaaagaacatcggttagttgagtaaccttggcatagtattaatgaataaaggcatttttgcattataaattatatgcagaaacttaccctcttagaaacaggcagcttttataatgtccaaatttttgttttcaagtgtccaaatagactatgctcaaatggggtattcccaggcctcagtcctcttctttgagctccccagagacatacattccagcaggcaggtgttaaccagcccacccacccactgccactgctgattgggtcagagatgacatctgactcaaggtggggcaatcagggctctctttctggaattctgaattcactatctggtagaatagaaacgaggaaaatgtaaaggttatcatgcaaccatgtctgtttgtacaaacagatgggaaaagccaatctacagggagataagcggcagatacataaaatgaggtaaaaataagagaatttgtagccccagaagagaaaacggctgtctaatttctagttccaattccttactctgcctaagatgcatttctggacttgaaagacatctcagtgtacttatgataaagcctcctatcccgcctttcaaagacttaatctagtttaagtgggtttgtattagttaacactaacagagccttgagtagggcacaatctagatgaattcataggcaattagttcttaaataaagcaagcagaattccctaaaattagctcaagagaaaccaattttattgctttgtctcctatttaagtcccaaaagaattgtctcaaaatgggaataccttgttctttaatgttaaaatataaacaaaggtcatgggtttgagatcttcacaactagaccccaaaacaaggatttgagtgcaagtaatgtagtttggaggtcaatctaggaagcaccagtaggggagggaagaaataagacaagaaagatgaggaagacaataaaggatgtgttattgagccagtttcctgcaactgggaacttaattccttggagaactctgagaatcagcgtagaccatgtgtctcaaagtcatcccacccaaggcgtgctgaagctagggtgtttatacactaactcccatcagaggttggttgagggatactaggagggagcatgcatttccagcctgctgcttggtggtctgccatgctcccatggccagagagatccctcagggaaaagaatgcaggtacaggaactggaagtcctggagggatgcagtgaagtggtaaaagcaagtgtacacgagtgagatgcccacagaatctgctgctggttcatgtagaaaaataatagtgaggaaacactttgaactatctatgcaataagaagtttattctagtttacttattagaaattactgattaactaaaattggtagttttcagtatgttgttccttgccaattctttgttctcagagagttctctttccattaaaaaatgggattgggcaagaaatgtggactgtggggtcttctgactcatttaaatgagctccaacaaatatatttttgactcacagctagagctggaggaaacagttcctagtgtccccctgtgttcacctcctctttcaggtctcattgctggaaggaaggggatctgttgaaaaatatccccccacagaatgttgaagtaattatttaaaggatctactgacagggctgcaaatcttcatgtgcattgtgcataaatggagtggtagagtgttcaacaggctaatggtaggagtcaggggttgcccaaagattggcaattgttctaactacccctttgaagaaacatgggaagcaatcctttacttggtgcttacagaggctaaacaagaagagaaggggggtaggcagggctctgaaattatccttgagaaaggaagtggcagctgatgtggattttgtgtgcttcactaagcttaggtcagactcagtgagggccatcagtcaataggcattggaccaactggaggtgatttatagagtagtttactcctgcatttctctgctgctccaagtcataactcctctcaaactccattaaagtcctatcccttcagcacccctagcccttcctctatcccaactccaccactcctggtctctggtgattccttttgtatatgaacttatatagcatctgacctaaatgctcttctatatgtaacttttcctacatgtatgctaatcactctactattcacgggtagtttggggtagagatacaagtaagcagttttagcagcactcctagaaaaaaaacaacagaagtaagcagaggtggaaatatagagtagagaaaagaaaagtgtatttttttcccccatatttttcactgtctgtagtttagtattctgcaatatagcatggtggtaagtcatggagctgaagtcagttttgattttgcatctcagctgcaacaatgatttgaagcttaacctgtctagccctcagcttccccatttgtaaaataaaaatcatacactagtagactaaactagatttggcattaaatgcatgggatataatatttaataggtttacattgcctttgttattatcattctcctgtgtccacctttgtctcttacagcatttacccattaaccctcatcgtcatcatggcagctaatgcttagaggccacaaaatgatccaggtattcatctaagtattttataaatattaacttgtttaatctccatactcttacagagagtgtttttatgcccatttcacagattaggaaacaggcatgttaagtgatttggtcaagatcatatagtcagaaattggctaagccagtgtttgaaccagacagccaggctccagattctgtgcttaaccaccattcagtgtcacttcctctacaaataggcaggaggccagaatagacttttaaaagtccacataccccaaattatcccttctgcatcacacaagctgtaagatatagaccagggtcaggaaggaataccagagtcaccatgttattgaacatacttttctgcctacatatcccaagggctaagatcctgtttcggatctttttctattcatcccaacaatttactcaaccttgaggcaaacctcagctgggagaaaaatgaaatcagctctttgggatggcagcatcaatttttaactgcaactgtcactgagtattagagttgcaaagccttgggaaatgttgatcaggcatgggttccttgtgtgccatggggctgtgaaatcagtctaaggtttcaaaacataaaccagtcttttatcgtcttgatttttttttctttctccattctgaaggagccatccaatatacatggctccttgagcccagatatgaaacagaactgttttcatcattctgcactatagtcaaggtccagtcagaagacagaaacctcattgactaattgaatgggaaaattttaaggtcattaactactaaaaagggcaaaagagaactccaaggaactcagacacagtaggaacaaaaaggcagctgctccttccaggctgaggaggagtgggcaaccaggaacaaagggccgggagcccctttcccaggggcaagactcagccctccttgcagagggcgtggtgctacagaacatgcagtctgccaaagaagaagaaacttgccagagagcacagacctgcactggcctgacctgcatggtcaggctcaggtgggtggaagttgcttggaagcagctacacagttgacagtggtctgtggactccactggagctgagccctacaggccatcagctcctacaatgattaataaataatagaagacacaaactcagaagggaagagtcttcacactctatagccttgcagggtcattccgctgtcctcttttgacaaagcccaagattcagccagctggcaaaggggatgtttacagggtccctcggcagtatcacaaagacgggcaatttggagctgagagacaataaattggtaagtagaatatgggcatatatgaagctgtcagaccatggataatattatcattactagcatactattacacttaatctttttgacagtatccctgtcgatttcagtctctttagaagtaaggcattagccccagagttaggtagaatatgtgtgctaatttattcatctggcaccatcatttaaatcgtacaattgtgtatgtgtgtgagcgtgtataaaactgatgctctatgaaggtgttctgtcaattctgtgaaacaatgactttgtttcattcatcattatatccctaatgcttggtataatgctctgcacaccagacactccatgaatattattgaatgaattcatgagtgaatgaacgaaacagtaaacagggcttggcttatcctgtggcatatcctgtactgtatcactgagtaactcaggaggctacaactaccccagtttggaaatcaatggacaaagtattggctgatagtgtagagttaggaacatgcagcttcatatgtcaggacctcctgaattatcaccatggccacctaatttttcttagactgcaaacatctctagccaaacctggaaaagtgtctcctggtacatggctcatgaatactctttccccagcatttctcatggctggatggaactgaaacatcacagctccagaaaagcctcccctgaccaccttacctaaagtggcctctccatcctactcctcaagtcattctttatcatggtgactcccaaactttgctgcccattagagtcacctggggatctttttaaaagccccattaaagtaagcgagactacagcactagtataaggctacatacatacgtatatgaaacagaattgagagtccagaaataaaccgttacatttataatcaattaattttagacacagaaggcaatataagtcaaagggaaagggatattcttgtcaacaaatggtgctgagacaagtggatattcacaagcaaagtgatcagtttagacccttacctcataccatacacaaacattaactcaaatagatcacaaacctagatgaaaatgtaatactacagaatgtttagaagaaaacatagaagaaaatgtttgtcaccttggattaggcaaaaagtttttagatatgacactaaaagtcaaagtatagaagaaaaagtcaataaattggacatcatcaaaagtgaaaggttgtacttcaaaagatatttttaataaaatgaaaagagaagccataaactgggagaaaatatttccaaagtatatatcttattaaagatatccagaatgtatgaagagctcttacaattcaacaagacgacaaacaacaaagttaaaaatgggcaaaagatctgaatagacattttaccaaatatgatggatgaatggcttataagcacatgaaaagatgctcgacatcattagacattatggaagtgccaataaaaaacaacgagataccagtttacaccctcaaagatggttacagtcacaacatcagacattgagttttggtggaaatgtggagaaacccttcatacatcactgatgggaatgtaaaataatgccacttaaaaaaacagtttggcagtttcttaaagagctacccatggagttgccatatgacccagaaaacccactcttaagtctctaaccaacacagataaaaatacattcccatgtaaagatttgtatgtgaacagtcaaagaaacattatttaccaaaaagtggagacaactctgatgtcagccaactggtgaatggttagacaaaatgtaatctacttataccacacaatcaatgaaggaataaggaagaatgaagtaataatacatgttacaacaaggatgaacctcaaaaacatcatgctaataaaaaaatcaggcatgaagaccacatattatataatttcatttatatgaaatgtccagaaaaggcaaatctgtggagaaataaagtagattggtggttgcctggggctgatggtgagaactgagattaattgcatatgagttcagtagatgttttgaggataatgaaaagtgttctaaatctggattgtggtaatggtggcaaaattacagacacactaaaaattatttacttgtacacataaaatgtataataagatagatggatttacgatatgtaatttacacccaataaagcagttttaaaaaaattgccaatacccaggtatattagggttctccagagagagagaaccaatagcgtatatgtatacataaaagggagtttattaggaacaattggctcccatgattacaaggcgaagtcctacaataggtggtctgcaacctggggaaagagaagctgatagtggctcagtccaagtctgaaagcctcaaaaccaaggaagccgagaatgcagcccttagtctgcgggtgaaggcctgaaagcccttggggtggacactggtgcaagtcccagagtccgaaggctgaagaacttggagtctgatatcgaatggcagggggaacagaagcaaggatccagtaccggaaaggaaaaagagccagaagactcagaaagcaagcttatcccacattttcctgcctattttgacctaggtatgctggcagcccaagagaatggcacccacccacatgcggtgagtcttcctctcccgctccaccaattctaatgtcaacctgctccaggaacaacctcacagacgcacccagaaacaatacttcaccagccatctaggcatccctcaacccagtcaggttgacacctaatgttaactatcatgccaggattctcccattcaaattagacaaatattgctggagtaaagtcaggcatcagtcatttttaaagttcctcaggttctgttatgcacagaccaggttgagaactacagcctatcaccatactattcaaaatacgctccaaggaccagcagcatctgtatccacctgcgccctgattagaaatgcagaatctcaggccctatcccaggcctactgaatcagaatatacatttaaataagatcctcacatgatctagatgccaattaaaatttaagaatcactgctgtattacttcgtatttatcataatctttttaaattttttttttacttctttgctgtctaccactaggaacacgtggtacaactccacaaagaatgcaaagtgaatagtgcttcaatcaaaattctgagaaggcagggtccctgaacactacttcttctttatgcctagcagaattcctgtcacaaagctggtactaaattacacaattgttgaataaataaataattgtcaccctccactccatttcctttttttaaccgttagactcctaggaatagtcaagacctagatgaaaagtctcctttgccaactcccagggcagagtcagttcccatctctgtgaccctgctggtcatcaggacagcactagcagtatcaggaatcctcctcccatagaaagggcaccattaaccaacggagttgtgttatccaaagggctggatcttttctgcacaaattaatcagttaatgcatagaaagcattcaactagtgattgtgttataagagatctgctcaatattactgtgtgtctaccttatggggacacattggtaaacaaaaactgtcatggaccgtgtcctatctgggacttataattcactgtgggaaatggagagtaaccactcaaagatgttggccatcttagcatgttatcaaatgccagtcttctcatttctgagaaggtctttcatccaccaagtctttgtgtagttttgctttttgtgtgcttcctgataatgcaaggcataatctcagcatgtaatttacacagcctccctactgcatggagactgactctcccaaggcagatgctgagaggaggattctagtgtaaatcgtttatttggaaggtctcaggaaataccaagaggggcataggcaagtgagatagaaaaggaacaaagcaaattttaaaaatgtgttattaagtcagatattgccttagaaacctggagcttgacctcaccggggaactacaggaagactgtgtggaccacacttcagagagtggtcctgcttgagggccagagaagctagaggattttctactaccttccctatctgttattagctgaaggctgcttccagaaccatcagctctctagcactttagatttgctaagagtgattccttgtttggaaggggagtgaggtgaggaagagagaattgcaggtgtttaaaataaacagccttccacaggctgcatgccaaagacatattctctgagaagttcaaggaatattggcggggggcagtggggagggaaataacagacattcaaccccgaatggacaagggacaacacttcttaatggctcaaagaggctaaccttggagaagtgaggtattcaggtccagaaagtttctggtgaatcacagaaaaacaactttgtttccaagaggccaagtcagtagctggtagcatggagaaaaagcaaactgaatgaaatggaaatgacatttcatttgccttgccatccattctgctggccacctacagtccctccgaggaaacacccagtgaccactggctcagacctttgctcttaggctaatgttgcaactttatggatatagccccaaatattattgggggtatgtgcttgtagatgtgtaatgtttaggggagggactttggggacccattgaaagtctaggacccaacccactgatgtgcagttactaagcagagctgaaggatcgaagtcagccaagctgtccactcatttcaatgtggcaatcttcccagttaaggtctatggtggcaaatcaaatattctattacattatttttcaatttcaggcatttccctggctggactcttaagtggtatattttccaaagttctgaaacattgtcctgctcaccatctgccttgatgggctgacatattggacaccgagtctgggaccaaaacatgtgtgacccaaggacaccattttgtcacaggcttatagtgcctgaggaatgatggaaacatggagatctcaacccagctgaaccaaacaccatggatccatacaaatggcttctctagcattgctggtatttattcagcatttattaggtgaatgtaggttagctttacctaaaaatttttactgtctccttttctccaatgagtactatgacaatttggcctttcccaatatagttatgcaacatctgtcagatatcaaaggcagctacaggcagcattttagtgccagtttaacctgattaggtgtgttgtcaatgattggaccttgaaacctaagcaggtggcttgtgttttactctctctgcctccccagctctcctgtgaatcattgtctaaatttttgggacccatatctaagaataattcgtattctttaaaggaagggaagaggaaggagcacagctggagccagaactctgcagctctcttaagagctagcctggattcgctgaaaaggacttgagccagatattccatacccattagccggtgtcatgaaaagtgattagcatttagtacaaccacaacaaccattaaaatcaaacaagcccttgatcctagctccctgtaaactcgctcaattccagctcttcttgacactgatgtcattaattagtgacacaactcatttccatgagtttccccactcccacttcctacaaccccttaatttgatcctaggggaaaccaaagtaactgagaaaggggaggggcaaaaggcggaatgaagatgtaaccttagctaataatcttggggcatatgagatggaactctgaggatgcttagtgccatctggacctgtggattttgtgatctaggtaggctctttctgatggattgagttgagggaagtgcttgtgagttggctgcaaccagggaccagtgccatttctactctggtgaacgaggcatagttattcatcattgaatcaaggcatcttagagtgaaaaagctggaaagctcatctgttccattctttttctcaacacaggagccacttctaccactctgtcatgctggacccctattgatttcaatacagatagcaccatgttcaaaaagctgaagaagagactcagagccagtgaaagagacagggtctattgagggaacttacatacagagcagtcgtgtagaggcgagttgggaaggagccgctactgatttgtaaaaacatgcagtttatatagatcagatgtgtctgcattcgcagggtatgcttaattattgctttcaggtgcgtctgtcataagggtcattctcagggtatgcttaagttacgatattgctatcaggtgcatctgccacccactccaccctgctgcacgcacggttgaattgccctcacgttcttatcatgccattcttctataatttcccaagggccaggtatggggaggagcattgcagccagctgctgcagcaccaatacaaactacaacagcaaaaaaagaaaagaataatgaatatatcataaagctcttctaaaggcttgggagttgatcttagatgcactatggtaggcccatggtggaggagaggggcagctctctgcagatgcaacaatctgtttagttctggagagaggccaccatctgcttccatttggcaaagaggtttgttgcccatcatctatgggcagaaggtaagaaagagcaagttatggtcatttaacaagacacaggaagttatgttgttctgcaagagctccacccctggtagtgatctggtcctgtttacaatgccaaatggaatggccccctctgtgacacattgcaggagggccaaaatcagacaatggaggtattgtaaggttcgataatgagaggatgattgtctccttgcacaagggaggaccgggatttattatttgagaatttcagcggggagtaggttgtaaaataggtatgacctgtatatcttgttctaggccctccctccatggagtggaaaaactaaactatcggtggctggtttgccatgtccagggccatgtaatgatgtgctccccagtgggtaggtggtgtggcaagggcaacagcagcttgagtcccaggttgggacaaaggtgtactgtccctgacactgtctacctggatcctgatggtggtatcaggtccctgcatcagaagagtgtatgccctggggtgatgagaatgcatgtgttcattcaaggtgcaaagggctgctggtaagctgcaagtccacagaaccagacagcaagttattgcttcaacagtccattcatccactcaatcagctctgctgctgtagggttgcatggcaggtgggaatgccagtggatatccagggtctccacccattgctgcatttcatgactggtaaaatgagagccctggtcactgctgatatcagtggagacacagtagaccacatacagctgccccagtcctcatatggtggctttctgggtggcacaactaatggaacatgcctgcagtagccctgcacaggtgactgtataagccaaggtatagaggcagccctcagacagaagcaaaggtcctatgtagtcacctgtcactgtagtgctgggcttctgctccaggtgatctgttcagcatcatgcagcaaggatctggggtgttcctgcacttcccattgcagtggccacatcatgagtcccttagagaccacccagccattggttcacaggactatcaggtccactaatggagaagaatcatccaggtggctcgtggttcagcccattggctaccatgtcctttgcctgtatcaaaccagatcctatcagtggatggccagatggccacaactgtccaagcgcaaggattgccttgagacaagctgtgtgccaggcctgtacaaaggaaggaatccgtggagggtcagtagcctccgtcaaaaactgtccttcagttgtcacataggtgacagggccaagcacaaaatggggctctgctcaaggggctattagttagtgcactcctctgtggcagtcatgcatgccatttggccagtctgtgtctgggcattcccagactttggttcctggaagttatctcttagccaacctgctaaggagtactgagcatgtaccatgaccccctttgtaatgtcctccacttgttgtaacgcatatacagcacagagttgttgcctccaaagtgacatttttctaactccagccctcttccatagttgggaccagaaccttaaagtcacctgtttatgttctttcctttgccataggccccactcaaatccctcagggggacgggctacatccaattcacaaggctgtccctgcactagaactcccaaggtttttatttgtttcactgagactttagcttgttcaaaggcctcatcctgatttatggaccagtcccattgggcccccttcttgactaagcagtatgggggctgaaggagttgggccaaatgggaactaaaaggatgcccataccctagaaggcctaagaaggaggtttgcaacggctttggtgtcctgggacatgagtaggcctgcaccttatccataacagcagccggaacaactttagtcttacccgacaagatgacacccaattatttgattgataagcctggaccctggactttgcctgcattgaccacccatcctctgttcaccaagtgagacagcaaggtgggggctgcagtttgtaaactggaaaaagactcagaagttaatggaaaacatgtacccactccacggtggtgtccctggggtaagatggtaaagatccattgttctaatgcttgatagcagaatcaggatgactatacttagcaacaatattttgtatatttcaaagtgactagagttgtgcaacatttgtcaggggtcaccctgatgggcccctgggctgtctgctttcctttagctcccttgcctttcgtcctgacagcacgccctcctttgcctatgcagtttctgcatttcccctaagtcagcagctcaagacactggctgtcctaccaaggaactcaggatacatgccagtgtgccataccattggctgggtgccaaccgtaagatgatgcctttcctgctggcagtgaaaatctcatgatcagtacctcagtaatgcttaacacagacagcacgcttcatcccttattcccggaggatgtcctgccattccttcatagtctaccattgcaaaggaaacgtgaggatgtcttcttccttggccaggctgcttggcagccggcaaccacacagtcaaggaaggaattggcccaatcttcattattggtgccatagaggcactgcctcagggccaggtggtttgggatggatgccattttacttatctccagtattgacaggataacaccctccatttccatgtcccacagacggagaagccatccctcagtcgactctctccccttctgtctgaacctatttcccagttccacccattccacagcagtgtagtcccacactgtgatgtgctgccatctttcaggtgggagcaagttttgcaggtctgctccctgtgggggcaactggcctgcttttatctttgtagtgactacgagacggacagagaggacagaaacctctataggcttgtcccagtcctcagtctcctccatggggtcccaggacaatctagtcatgatagccctaactcgttaacatcacttctggcaatcctttagatgagctacctgacaagccagggtctccattttgtcaccctccatgtgggatagtaaggtctctgagatttcagcctgaactaatctggaacctctttctagtcatagttcatcctgtaactgacacacccttgcttgcgctacaggattagcttcaggggctgtcaaatcgcagtcaggagcagccagccaaccatggctgccacagctccagcatctcacttttactcagatagatcaacgcctgcaccaactcttccaggcccttcagtgttttcagggcatccctgtgctcacacactggatcctgtccatcaagagtagtggctatcaggtcccacacaggcatggacagccagcctgagatttctccctcatatttccccctttcccagtcccattgtcttggtgctcatgtagctttctctgacctcctggctggtgtgcaaattgtcatgccaggcccctattgaagtcatcttacagaggccaaagaagagacccagagccagtgaaagagactaggatttattgaaggaacttacatacaggttggtgcagtggcagtgggctggacaggagaaccattaccatttgtaaaaagcatgcagtttatacagatcaggtgcgtctgcattctcagggtatgcttatgttattgctatcaggtgcatcttccataagggtcactgtcagggtatgcttaagttacattactgctatcaggtgtgtctgccatacatactcccatgatacatggttgactgctgcctctgcttaaactaaggttggcaagctcagctatcttcaggggcaaggaaggccagatcagtgagtgaaatggagctcagtctaaaacaacagggagtagtgaggtctgataagaaccaaaaagctaatgccccagctgtgcagctccaggcaattgttaaaatgcaggataagggcggtgtgtaagtgtggggtgtgtgtgtgtttctgtgtgtttgtgtgtgcgagagagagagagcatgcacgagagcaagagcaggagtgcacaagcaagcatctcaattaaaaattttttaaacatcaacgattaagaaaatactgaataggcaaacagtacccatgcatatgtaagtgacagtccataagctaccagcttgtagctctggcttatgcagataacagggagcatacctcacaaaccacatattgcatggaacagctatttttatatattcatttctttttaactgaatgggtaaataatacccaaccatatggtgtgtcccattctttcttatttaatacacttttatttatcacctactatgctccaggtcccctcctcaaccaagggatacaaaaaaatctgttgggataacttagggaataagacaaactttctcatggaaagttcattttacctaatgaaggataactctgctgtccttatacctaaatcttctctttctagattaaacagctctgttgtctctaacccttcctaaagtggcaggttttccttttcattttcagtttaatatccttcttaaaatgtggtaaaacaggtacaaactactagtcatggagcccctttctgaatgtgtttcagttcataagttttgttaaataatttgctgaacatatgcaaatgttttgctgttcggtatacctaccacccctttatggtttatctgggttttggtgtgaacacatatcttcatttctaagaatcctaggatataaagtgctccacggacatctctgcacccagcaactacaatttgttttcatattcttcgtaacttaatggcacaccgtacatgcatagccaagcttatttgctcttcctgtgcatgcatttccaaaggtcacggatttcatgctgaagtgctacatgatataagcatttccaggagcacttgaggaaaataacattaattgcctgcaactttaattggttttatgacagtagccaggccagtggctgggaaaagacaccccagaacagctgtcaaatacacaacctggcagaaaggcatcaaatgccacgagccctttctgcacagaactgacatttgagaggcccacacaggccaagtgatcagaaaaatctgcctccatgtaatgatttttcaaatccacttaatttaaaatgatttccgtggagcatgcaaaacatgccacatttcagctctggctggcaatagctgcacttggagtaccaaattctaaaactactagtcattaggtgagtgtttaggaatgtacacaatgattatgccgcaattacattatttattcagcctttgctaggcgcgtatttttgtaattagagattatttagggaggaccacatggaaatcaacaatctcgatctgccaagaataacaagctttagcaatcatatatgtatcctcaaatgattgtcctgtttctctccatcagtaatcaggcgtgagctctgtcccttatcctagtattttatctcctgtctgtatgagataaaaaagcacaagcctgtaaggattgcaaatattgatggtcagttatcactgctcaggatgtgtagagctaaaagaaaaccaggttgagaatcgcgagatcggggtctattcctaaattctgctgcttaatattgactgagtgattgagccatcaaaatgatctgcagggagatttaaatgcatatatagaagcaagttgaaaaatatgaagcactatgcaaaagtattgtgatactatgattattgtagctctgtttcctagaaatccctactataagatcttaaatagttacaacctgtctttcatcatgttcttttttcttttttttttttttaaacaagaactacaggatcagttatctaaagccacttatacttctatttcaatttcttcactctctcctatagcttgctaactacagatcaatgggctagattgagcatatggagatgtttaaattgacttgctatgttttggttttgttttttagattgccttgttgtccacattttatatttgagatatttcatacggatatttccatttgcagttttcatatcaaaatctagatgttgtacttctcttgaaaaacaggatgacctgacaacattgatttgcatcctccacagctgcaattgctggacctgagagcagcttcccagagggtaagttcttgtcacatccccaggctgtccacctggcctgcctcactcatttatgtttctggctgaaccccataggcacttagatttcaactctcactcttcccaattcttttgtttcagagagataagtctctaaagtaccaaaaatgatggaagctagaatattaaaaagaagccagaagcctcaataaccaacatattgtacattaagaaataagaaaagagatatcaaacagttactgtgagaagcagcaaagtggttaaaagtataagtaaaataataaagcagtatcaaatcatagccacagttcgtactggcttaggagaattacttaagctttctgggcctcagtttcctcttctggaatatgggaataacacttgtttttagaattaatttaaataagtttttttttttgagacagtcttactctgtcactcaggctggagtgcaatagtgccatcatgggtcactgcagtctcaacctcctgggctcatgcgatcctcccaactcagcctcctgaatagctgagaccacaggcgtgcaccactatgctcagctaattttttattttttattttttttgtagagatgaggtctcactatgatgctcaggctggtctaaactcctaggctcaagcgatcctccccattcaacctccaaacatgctgggattacagatgtgagccactgcgcctgacctagataagtattttttaagcactcacaatgtatcatgaattcttctaggtactggtaatgcagcaataatccaaacaaagcctgtaatcatgtggtttacattaaatgagagaatccatgttaagcacttagaacaaagcctggtacataataaacactcaatacatattagcaattatgttattcataacatattgtctattcaatagtgattacttaaattaggaatggtaaatctgtttaagcttgtgttttatacctgatagtagctaccagaaatacaaagctaagaatgagtctgaggtcatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactataaactagttcaaccattgtggaagtcagtgtggcgattcctcagggatctagaactagaaacaccatttgacccagccatcccattactgggtatatacccaaaggactataaatcatgctgctataaagacacatgcacacgtatgtttgttgtggcactattcacaatagcaaagacttggaaccaacctaaatgtctaacaacgatagactggattaagaaaatgtggcacatatacaccatggaatactatgcagccataaaaagtgatgagttcatgtcctttgtagggacatggatgaaactggaaaccatcattctgagaaaactatcgcaaggacaaaaaccaaacgctgcatgttctcactcataggtgggaattgaacaatgagaacacatggacacaggaaggggaacatcacacaccagggactgttgtggcgtggggggaggggggagggagagcattaggagatatatctaatgctaaaggacgagttggtgggtgcagcacaccaacatggcacatgtatacatatataacaaacctgcacgttgtgcacatgtaccctaaaacttaaagtataacaataataacattaaaaaaaaaagaatgagtctgaggcatatccaggcttagcagaaagaagctcaatgatttattattgatgtctacttggatttgagttatgtgcacgaaaatttgcctggaggttttgccgttctggtttaaaggatccctcgttctgtaaagtaagcatgatttctgcctctcttgtccatgttctcagtctctctgaggctttttgtttagggagagacaagatcatcatacccaggtttgttttccttttagcaggcagctcaggaagacaaagtcatgctctgctgttgcagatgcactgagaacacacaaagctcaaagggctgctagcctgcaattagggagggtttgaggatacctgttccaataaccagctgcaaagatgatcctttcagagctactaatgcaacttagggggactgaaatgtctgcccagtgagggtacttttctcctcaataaaatatctaatggagaatgaaagaaaacgaaaacatttcaacaaatcacaccacaaaacccaagagatcgcccccggcaggcctggaggctcttcgtggcagcatctctgcccctactactttccctccttgatgcccccataggtcttctgttctcaattccagaccaggcaaggatggaaagacagtacaagtttcctccttcacaggcaagcccaaatgttcacttgcaaacccctcaggggtacaaacgaaataaaaccttttccaacaatattaaatgggaacctaccgtactcccttgaagcttgcacctgctggctcagccaacggcttcattccatcttccatcagaatcacatgtggcagccaagttcccagggataaagaattcacagccacgggctgctgataggaaaggtcacggggtaatgaaagacaggaagcgtgttctagtgtccagctgaaaggtgaacaggtgaggtgacatcccgttattaagtagacatgggcaataatgttgggggcaactgtgtaacgtgcctcaaatgtgatcttctgtaccgcctcacctcccctgggaatgctgagtgttggaaaatgattctcaccagcctcctcacctatacactccatatttccacaggattcatactgtccctgttcaggtaaaacaaaacctgccttatgccaggacaggtagactttctgaaacatgtgattgcacaaagtagatggtctctagggtcctccttggtttcatacttggcactctgaccttttctttcagagcgcttgtcactgtatattatttatttgtatacttccttatttaatattaatctcctccatcagatcataaacatcttgaagacacagactgagtcagtttttcaccattctgtgcccatcctccagcacagagggtggtaaacttttactttaaaggaccagatagtaaatgtttttggctttgtggaccatacggtctctgttgggactactcgcctctgcagctgcagcatgaaagcagccacagataatacgtaaacaaatgggcgtagctgtgttccaataaaagtttattaacaaaaatgggcagtgggttgtgtttggcttatagtttatcaactgctgatctagcacaataaatcattaataactatgcattaagtataaaataactattgttcatctccttgttgagtctcaacaaggactaaagactaatgtgatgtgattagaaatcacgagtacagagggcagctgggcactaaatggggcacagagaccatgtagggctgaaatattccgtttcttgttctgagtgctggttagtggatttacagtgtggaaattcatcaggattcacactcaaatctgagtacttttctgcatgcatgttatactctgaaacgaaagtttacaagctaagaaacaaatataaaaataaagcaaataagggccaaagagagaaagcagggcatcactgcctgctagatttgagcttccttaatgacagctaacgataacaagaagttccccaaccagctgtgagtctagacctagaggatcagctataccacctactggcaaacgagcaaaaatatggctgtttgatctgtcaattccatagaaaaagttagtctcctgattatgaaatgacttttgaagcccaaaagacatggattctttaacttctctgagcctccatttctcacccctaaaatcatcgtgtctgccccacaacactgttgtaagggttaaattatatagtgtatataaaatgcctagaacagtgcctggcattttttaatactcatgattagtacccagggaacgtcagctaatgtgaaaaaaaccagagtggatgtctttcgttgcccctcctcatccattctccatccttctgtactgtgctccctgccctgagttggccagcatgggttctcttgcccctccaggttccagtgtgagatcagggaagttatttccttcaagcagtaccccttaacgaaatggacatgaagcctccctttcacccagtctctttgtctttaagtccccataaatgcttcttcttcttgctccttcaggccagtggatgatcactgctccctcctattaataaaccttgggaaactggatatttctgtggtttctccacagtacttccacacctttgccctctgtttcccggactctgactaatgcaccaactacacattaggaaagtgaattcagctccaagcaaggcaagaacatttctggaaatagtacattatgctttgttttggctcacatatgggacttgaaaaaaacaaggggtatttttctctaggcccagcacacacaggttataaggctttgtttgccaaatctgggctttcttgctttcagagttcattaagcctgagtttgtttttcaggagtgaaaacagctgttacctaccaacctagaaacagtagctttgtttgggagtagatgctcagggaggtaagctggtgctgggggtagtgacgggtttgagggagcctgggaagtcacccgcactccttagaccaatacttcatctaaggtagcaatgaatgtcaaaggcctaaaacatctggccatagggattttggatccttgtcaaatagttcccactccaacttgattgcagaaatatctgagctgccttctgttttttttgttttttttttgtttttgttgttgttgttgtttttgagatggagtctcgctctgttgcccagactggagcacagtggaaccatctcagctcactacaacctccacctcccggggttcaagcagttcttctgcctcagcctcccaaattgctgggattacaggtgcctgccaccatgcctgactaatttttgtatttgtaatggagattgagtttcaccatgttggcaggctggtcttgaaatcctgacctcaggtgatctgcctgccttggcctcccaaattgctggaattacaggcatgaaccaccataccaaagacggcagagctgccgtctttgaatgcagagaggggtttgaacaatgaattctacagcagtgaccacgatgtgctgacaaccagaggtctttctagttagcattgtgggggtcgtgtaaatgtcccaggagttctctataatcccaaaggacagtagaggggcccccctgatccataactggatattccaggcttcaccccagtggttctgattttgtgtgacttaagttgggcccctacattgcatttttagcatgcacctcagcaatgctgatgcaagtagtcccttaagcacagagaggcagatactgtaattgtccccattttacaaagaagaaaatagagcctctgagagcctaaccttctccagttccaagtgtttggaaggtctaggccaatattggttgagtgaggaaaactgaacaaattgtcctttcttttgtgtagagtacaattcatgcccacataagaagcacaattcttattttattctggggaatcctgccaaaattcaaatgtttgcaaaattccaagaactgagtggtcttctacttcttcttttgtaatcaagtaagcagaaacagtgtagccagtgaaaagctcaccacaaatgtttattagataagactggtctggggcacgtcatctatgaaggtgctgagcaaatccaagaaatgtttcctatcatactcttaagcaccaagcttggaaaatcaagcaaaacaaccaactcagctgctcacaaagtcagcaaaaaatgtttatataattaatcttcattatggcagttcagtcacaacattagtggcaaatatacccacagaataaatgcaaattgtaggtgcaaatcaatttatgcattcagcagcaattccacttgccccccacatacacacttaatagctcgttgaaacgtagaaatcattactggtcttcagaaagatgcaagtttgcaaaccaggatccgaaattaaacaatgatgacaaaatagcaatatcaaaaccataggcatcaggagacacctgaagaagaactaggagtgaatatttcggcatgccctggggagatggaagcacaggcttcgctgcttattttctctttttactctttctgttgctaagtctcctaaccatcaaaccctggtggtggtgggaggattttagaggagctcccagataaagaatgcggccagacttgcttccattccaaattacttggaaattgattctctttctcctctgaaatgtctcctcaggtgtcccagagatttcctttcttgtgctctggggacaaaacaaaaaccaaaacaaaaacatttaaaaagtgactggaaatacaaagacctgagagtcaggtgaaatgtctcagaaagttgtaattaagagagtgccctctacatgaacctgtgtaatgtagatactttctccctttattcacttttcagttctctttgtctttttggttgctctcagatgaaggtatcaaggtgcctctatttggcaaattggttaccttaattgttttctctgtttcttaaaagtcaacaggtattgatttggttcagtcttctcattcttccatgtccccatctgaacataattttcatttttctcacgatgcctatgtttaagtgtaattattgtagtaacagtctcattaagtgacatgtttggaggagaagggctctggttaattgagtcctaaagaagagaagatagctttaatttttcaattctcattgttgaaaatatttatgcttttcatctgtcttttcttcattcatttcactctcatttctaccaacagaaaaaaaaacaaatcagtatcattacacaaatatccaaattaatatagaaagaaatcaatataaggaatcatggctgcaaagggggtaggaacagcaccaggtttcacatgtgtgcaatcatgactcttatttggcaccaagtttagctctgagatccctggcaggcaaagcaaaacaagaaatagatcccatgttttaatcaaaagaagcaaagtagttcacaaggaaagacaaactttctttttggtgggaaggagggtggaggaaagggacatgaaaatctaattacagtgacttaaaggaaaagggtcatgtgactcttcatttgtggcattggaccaatctagtgtcacatcattggacactgtcatgtcggcagaaggaattttttccccttttcttgcccacacctccacacaggcattttacttgattttgttaatgttttaccaccacagatctaacccatgatgagatcgtttggttataagatgacaaaaggcaaattaatagaattatggttctactcccaccctccattagttctaccttttaaaaatgtgttgtacaaacatttaggctagtttggcagagcacccctgaaatcaatccctaagcatgttccaaagatcacctaggtatcccagaattaattggagacccaaatatgagttaccaatgatagcaccatactagtgtaaggagctccaggacaagagtttacgttttctaggtaacattaagtgcctgacgtttgatctctctgaatttttgattctgcatggctctaaaggagatcataaattatactaaatgaggatcaatcagttcttttcaactgaaatctagatttcagtttcattgtccccataactatcaaactgtcatagaaattgagtatgtcaacatctagagttatcttttgcatgtgaaagaagcataatgattcttactcagattatatgtgctgattttcagtttataacctgatgattgtatgtacatcccatgtaagtgctcttcatcctcctgtaatactagctaggagctttatcactcttagaaagtacttatcttatttgcttttcttacacttcacctgctctaatgcctttaatttttaacttgtgtatttaatccagtttatttaaagtgatttaagctgtatgtcttgggaaagggagacctcagctattctaaatgaacagttttaacattctaatttggaatcacaggaaaaccaaatctatttggtagaaaaggtacaagatccgacatcaagaaactcatgtttgattcctgtccctcctctttactgtccatttgtaaaacacactccaaatttcttagcctttctttcctaatctgtaatatgagcgtaacaataataattcctcctttttaagattgatttgaagattaagtttgcatatttgagaaaaatctgtcaactgtaaaattacattcacttcttatttattgctattattaggcccaagttttttttctgattatgaacacagaaagccacaagaataacaggaaacttcatggtgacaagaattctattaagcactttaaatatatggattcatttgaacctcacagcaaccctaatgcagaattattcttctcatttttcaaatgaaaagcctgaggcagagaaaggataataaacttgtccaacgtcacatagtcagtaaatggcatagctgagattcaaacccaagtgctaagtgcacaggctcttgtcactatactgtatgtcctcagcacacagctatagtaagtattaggaatattaataaatgtaacacacacatgcacaaaggattccatcatcaaacaaggttaggaaacactagattcaaccaagttaactaggcgtcttgactgcaggactcctcagaccctttaacaaatgagggatggtgttcagcaaattccaagaccaaactgaaaccaaattgtttcttcatgagcatctcaaaggacttgggttccagggaatacattttggcaagtgctcatacataagtcgtgacagataagtagcaatgacatgccaattaagggctcattaaacaatcttttgaggtatgggagagaaatataaaagtataccctaatgttatttatacatgatctccattttatatactacctacctacccaaattaaaaaaggggtattgcaatcctctttttaaaaatgcacgtataaatgttgcttttgttttgacgaaaatgtaagagacatagtttttttcctctctccaggatggttctctgaggctgacatttggagaagaaagatgtgcaaggaggaactaaagcttcacatgccttgttgctgtaagatactatagatcatgctgggtcagggctgagagagctctggggaactagtctctgcaagtgattaataacagcaaggtgacccactgacccttctcaggcacttctctacctgggcatctagaattacctccaggacatatggagagtgggggaaggagactggttccaaataactattaagtctatgatcactttaatagacttaatagagaccccaaggtggtaaatgaatccttgcttattgaattcctcactttctgctactagcaccatcactacccccccagcaccacccacccccatacacacacacacacttttctcctaatcagggggaatcacagtctagctgtttctagcttaacatggagactaaaatagcttaaaggtatgagtctggccagcttcatttgagcattaccaaaggaaaaggttgtgatgaatggcatatttgatccactctttagaaacgccatattggatgtttcccaccaagccatcagcactagcctgataacatcacttacctccatctcataatatttacttaccctgtgtattcgtggtatatccacaattatgttgggatattgctactggagtgaagctagaattctaaaagtctatacattcctatgaagtggatggtgagaacatctttatgtgcatttaggtcacatgatgtcattcctatgaatgatgcaggtaatctaagggcagattttgctgttatcctcatttcttccttcaagcttcttagcaatccaggtgcctcttgccttggaattaacaccacttcactctgcctctccttttctacccaaacacagtttcctaatcttccttttttattcataacaattttaagaatagtaaagatatagatggagtccaagatctcaaaacaaacacttcccattcggaatcaaaactgattaaaaatctgcttctccctgcacagattctcctcctagggatgtggagtggcattcctgaatggaatcaatgaatcatttccttccagtaccttataagagatcaatggcatctgtaatataacacttgtgcctcattgctattgagtttactcagggagaataccatgagactgagtaaggtttgcacgagtattctgaacccacggtttcttgaccctgttgacaaatctattaggtgcatcacttcacaggttgagatacaaactgattccaatgttgaaacaaaatcttcaatcttacagaaggattactgacacagcatggagaggaagtaagagaattagactggaatggacatttttagttagttccggtatcagctgagtcctctgggaagtagatgcaaagactgagtcagcaatgtagaagatgcattgtaaagtaaaacgtgtgaaaggaagagggggaaagtagaattgggtagggagagccttcagacaatacacagatctggtggttcagttgggtactgcagagtacagattgccctttaggggtgtcccgcattgggcagaaagcccttgtaccactgtgctgctcagtttttggtcagtgccaccccagaaaaagcacaactttggctcaaaagctagagttgactggaaggagataatagctgggggctatcagctatccatacttctcattgccaagcaaggacacctttcttaaatggagatttgcatgtatgtgtctgccaggactcaacatacctttcatctattcctcatagcggaggagacatacaatttgagaaggtcccttaattacagtctcaacactggaactctcattgatgccattggctataaatatgagcagagatacacaacagaccaaaagcacattaaatatggccacaaaagggattagtggtctcttacacttacgaatagaatctttcagaactgaacctgtttgtaagttgagggtgtttctagatatagcctgtggattcagacaacctattaattccttttaaatcaataacattttagggtaagtcgactgaaaaggtaactgtcactttggaaaaccaagatcaggaaatgggatacatgacagataagttatattgatgaagaaaagaggctccaggcagaaattgacaaacacagtcataatgaattttttaactcttaagttcatgggtacatgtgcaactttgttatgtaggtaaatttgtgtcatagggcttgttatacagattgttttgtcacccaggtattaagcctagtatccattagttatttttcctgatcctctccctccacccaccctccatcctctgataggccccagtgtgtgttgtttctctctctttgtcatgtattctcacttagctcccacttgtaagtgataacatgtggtatttggttttctgttcccgtgttcatttgctaaggataatggcctccagctctatccatgtccccgcaaaggatatgatcttgtttccttatatggctgcatagtattccatggtatatatgtaccacattttctttatacagtctaccattgatgggtatttaggtggattctatgtctttgctattgtgaatagtgctgcagtgaacatacatgtgctatgtctttatgatagaacaatttatattccttcaggtatatacccaataatgggattgctcatccgagtggtagtttgattatatctcttttagtcactagtaaatcaagcagacaaaattattaaaaatatataaaagctttgaacataattaaaagtttaatctagcttgattctttaaatagatactagccttacaacaacagccttcaaaagtgaagacctaaataactagaaatgtagacacctgggagttgttcacctttctctgtctgctctctgtggtttatataaacacatctgttctgtccccgtaggcctgctgcagccatagcatgcatgcgacttgtggtccacatgccagatactcttatctccatgccccataaatgtacattcacaccagtccttgagcagctgtgactgtgcctgttatcacagctctgtgtgcctaggccagtggcacatgcaactagattcacaagatataggtcacttgatattcatggattggacacttgcaggtctgattactcatgagtgcaccaaacatctatggcatgtagctatatgcaatttttctgaattctggagttctgagggtctgacccaggtgaactagttagtcactgagcctgtaagcaaacttcacagattgtccaggattcatctgtccactggcttaattttctactcaacagagcttatcatctctttctctttaggaacttagggggctgactacattttttaatcacacattactgcattttattggagaattttttatgttctgggagtgcttcaaatttggatattttcaatagaatgttggcaattattattttttgtaaaagttttatataatgaatgtatgtagaaccctgcatttcatatacagaaaatgacttgtttttaaacattcatggatcttttattaaaatggaccatattttagcttacaaattacagaaaataaaattttaaaaaccacaaagaattagtattcctcagatcgcctgctcttaataattaaaatagttatcgataacaaatacttagcttaaaaatccccccctacaaattagtaaggagggttaaatgagggagatatttaaaagatgggggcagacttagggaaacctcaaggaatagtgtagttctccaaggtgagtaagagtggagcaattactatcccaaagcctgaagaggaaagatgcaaaaaggtagccaaagcttagaagaaagaagtactgtgaggagaccacttggaaaagagaagagaccttaggttgagagtacagccatcctgaggccccaaagagacagcaacgtttgactctattcctagtatatttacagccacttcaactacaaagtcacagtacaccatggaaaacaccaaccctttagtaggctggaaaggagtatgtctatttattgtctttataagagaccagagcagacaatgaaaaggtattaagtattctctttttttttcttttcagcagaaagagaagccccttcagccttcttgagagaaagacacgaacagtccaagagaatagtgcctatatcaaaagagtcactacagttctcttgaccagctgatctggagcaggcagttggcctttgggtttaggaggaatgctttgcttcaggttcttgcccactgggattggatagtccaaagtatgatatgaacactttttatttttaccttggaaaaaaatactctccaggcctttcctatagtaccaactaagactcaagctacacatcagactatcaccttcattttcaaacctttgaatacatccaggtttgattcaaccctgacttttagggcaatagttacttatataggtcactcagatgcctgtattaaccttccaccaggaaggtgctttaaaatcacactaaacatctgtaacaagtcatctccaaacatcgttacaacaccactgcctccattccacgtggtcaccatggtcatcaattttacccagcaactacaaaggcagaccctcattattcctggggtatggcagcttgaaactctcagtgctagttcatttgcataagtgcttagcagcaaaaaatcttgactcctggcaccagaagtaaattattcttggagtactatacttagatgctttgagtttaattaccttgtaatttccaggtcatgttattaccatgaagctacatgattttgcaaatttatttacagcctatgaaaagaaaacgacttcggaaatgaatgttgctaaattggtcccttgtaaatagttcttttgttgtttagaaaacatttaaaagcttttctactagaaaatgtgggccagtcaaatgccaattctctaaaagtttacaataagaatcttatcttgagttagagatgtgaggtccctccaagtggagtcaggggggtcttcaaggtgatcaggcaggcaggtagcatttagaaagaaaatcatgaaggtaaaggggtcagagataataagaatggtcatatcagatccaggagttctgtcaaagtctgaaatattggtaatactttggatccaaagatcaagagttcataaattattaatattgttcaatgaaactttacaaaactcgaggatgacctgaatattgcacctgttagacctcattttattttggccacagaatatttatataacacttaaaaatgaggcactactggtttctagggggagttgagactgtttccttcctttctcatccctaacctgattcttacctctctaggatcaatagcaagtaaattggactcccataaagagaagaattgctgaaatttaaggacgttgatggtcaggactttcagaggggatcaaggtcatgtcatatgtgggcacggcctatctttgctttcttccttgctcctccagggaatggcaagagcctaaggctgttccagaagggcctaacattattctttctctctagagatgctgtctttccttcctgtaaggtagcttgggaagagaacccaggacagcttgttctagctctgttgtcccattgttggtagacattggacatcccttgtttcctggtgatggaaccagggccttaggcttgagcactgtaggaagttgagggacagtcagagccatcttcccaacctgctttatctgaagctgatttagcctaactggctttggagaaaggaagcttcagctgggtcaagctatcatttgacaactctgatgtttaggtttaatgtttaggtttgatgtttaggttcaggtttgatgtttaggttcaaccaaaatgacatctagttatctagtcaccagtgattgttcctaggaatgtatctctcacaaggacctcatagggaaaatggatgactggcccaatgcagaatttatatgttcctttgttatgagaacaacaggtaatagctcaggcttatcccaatgtccaacagccacacaatgaggtccattgtgtaggtgacggtcaattcctacgtaaatatggcttgtttttcctttagcctccattctttctcttgggactgcttcttgtttcctttgcctctaacactggctttgtccttcttcatttactcctccagcagtgtgtaccctacttttcctacccgccgctacctcctggctattccatatttattttctctttatcactccctacctttcagcctctacaccactgctaaccaccatccaagtttctttcctcccaaaaaataacagtggagcactcaaatagaacattttactgctcacttgagagctcagagaaaggatgtgctaatctgtgtatagaatgagctaaccatcaaccaacattgactattttctgattgaaacaattaaaagggagttcccagtcacaaacgctagcattttccaattttcaatgaccttttaatagtaaaaatgctatttttaaaatgtcattatgtgctaaaaatgttcttgaatgtttttcaaaaatgacattacagaatccaaatgttgccacataattattcaaaataaatattttgcatacattgctctatttactttatatcccatgaacaacacacatcagtatacatattaaatgctggaaccaaaaaggcatgacatattcagtagcttaatgttttattaaagtaaaaccagctggtggagatttggtaactgaagctatagcccaacttgctaaaacgtctgtatggttgcactgcactggaggaaaaaaagccagcatgtgaatttaggctatgagcaacagttacctaactcctgttacccttcaggctacaaatttattctgggggctaagttttatacatggttccttatagactttgcaatttctgcacttctaaaaaccgatttctaataaaaataagattctgatctgctaaagaaatacgtaaattcattgaatctctaattttgtagcagttgttgttactaaggacctcatatagggatgccaaagacaaatctgaatatagaataatagaaatgatgatgagactgtccctaagggaccgaggaggtagcatccaagcagcaagaaaagctctcaatatggtgaatgtaatactgtctcttccttcaagttgagccccttttcaagagagataggcatctgatcattacattatataaatgaaatatgtttatataaggtactatggaattacagaggagaagcaactaactttgtgtatagttggacagtagacatgagatgatgttcatggttaataaatggcattgaagaggagaagcaactaactttgtgtatagttggacagtagatatgagatgatattcatggttaataaatggcattgaagaagaggtggtatttagactgagtcttgaaatatggattggaggctgccaggtgaagagcagagacaagtgcatcatgtacaaaacaaagggattggagagagtatgtacaaagtgttaagatactacactttaaaagtctttaaactttgctgattcctggtcccatctgaagagtttgtcctattcgcagacgctgggtggggctatacttcttacctactacctgctcaactattactgattgggtcaaagatgaatatctgactcaatccattcgttgttaagtaaccaatcatattgtctctagagaatctgaagtaacagaccagaggtacttaagctaaaaagttgagataagggcagccatattacatgtggtcatggctatattaggacatgtgcagggccaaaaggcagagaaaactgggcccagagataaataggaaatgaacaggctcaccaaaaaaaacgtggcagtaaaagaaaccacataatatggtttgtctctgtgtccccacccaaatctcatctcaaatagtgattcccatgtgtcgagaaggggatctggtgggaggtgattggatcattgaggtggtttcccccatattggtctcatgatagtgagttctcatgagatctgatgtttttgtttttctttttcttttggatggagtcttgctctgttgcccaggctggagtgcagtggtgtgatctccactcactgcaagctctgctgcctcccggagtcatgccattctcctgcctcagcctcccaagtagctgggactacaggcgcctgccaccacacccggctaatttattttgtatttttagtagagagggggtttcaacgtcttagccaggatggtcttgatctcctgaactcatgatccgcctaccttggcctcccaaagtgctgggattacaggagtgagccaccgcacctggcctgagatctggatctgatggtttaaaagtgtttggcagttcatccactgctgtctctctctctctcctgctccgccatggtaagacgtgccttgtttccccttcaccatccaccatgattgcaagtttcctaaagcctccccagccatgtggaactgtgagtcaattaaaccccttttctttataaattacccagtctcaggtagttctttataggagtgtgaaaatgggttaatacagaaaattgctgccaagagaagtggggcattgctgtagagagacctgaaaatgtggaagcaactttggaagtggataatgggcagaagttggaacaatttggaggactcagaagaaaacaggaagatgtgagaaagtttgtaacttcttagagacttgcagaatggttttgaccaaaatgctgatcgtgccaggctgaaatggtctgagatggagatgaggaacttattgggaactggagcaaaggtcactcttgctatgctttagcaaaaagactggcagcattttggccctgctctaaagatctgtggaactttgaacttgagagagatgacttagggtatctggcagaagaaatttccaagcagcaaaccattcaatatgtgacctggctttttctgcattcacaaagagatgatctgaaattggaacttatgcttgaaagggaagcagaacataaaagtttgaaaaatttgtagcctgaccatacagtcgaaaagaaaaacccattttctggggagaaattcaagccagctgctgaaatttgcattaagtaatgaggagctgaatgttaatagccgagaaaatcaggaaaatgtctccagggcatttcagagttcactgcagcccctcccatcatagatccagaggcctgggaggaaaaaatggtttcatgggctgaggtactgctgtcctgtgcagccttgggacagagaccaactccagccatggctaaaagggaccaacatatagctcaggctgttgcttcagagggtgcaaggcccaagcattgccagcttccatgtgttgtagggtctgtgggtacacagaaggcaatagctgaactttgggagcctccacctagatttcagagaatgtatggaaatgcctggatgtagaggcataagtctgctgcaggggtgaagccctcatggagaacctctacttagggcaatgcagaggggaaatgtggggttgaagcccccacacagaggccccactggggcactgcctagtggagctgtgagaagagggccaccatcctccagaccccagaatggtagagccaccaatgacttgcactctgtacctggaaaagttgcaggcactcaatgccagcttgtgaagcaactatgggggctgtaccctcagatctacaggggcagagctgcccaatgccttgggagcccaccccttgcatcagtgtgccatggataggagacatggagtcaaaggagtttattttggagctttaagatttaatgactgccctgaagggttttggacttccatgggacttctagcccctttgctttggccaatttcttctttttgaaaaggaagcatttacccaatgactgtacccccattgtatctaggaagtaactaacttgcttttgattttacaggctcatagggggaaggaacttgccttttctcagatgagactttggaattggacttctgggttaatgctggaatgagttaagattttgggggattgctgagaaggcatgattgtgttttgaaatgtgagaagaacatgagatttgggagggacctggggtgggatgatgtagtttggctctgtgttcccaccaaaatttcatcacaaattgtaatcaccacatgttgagggagggaccaggtggcaggtaataggaccatggggacagtttcctccatgctgttctcatgatagtgagtgagttctcaagagatatgatggtttattgtctcagtcccaaaacttaaggtgataagcaacttcaacaaagtctcaggatacaaaattggtgtacacaaatcacaaccagtcctatacaccaacaatagacaagcagagagccaaatcatgagtgaactcccattcacaattgctacaaaggaaataaaatactcagcaatacaacttacaagggatgtgaagaacctcttcaagcagaactataaaccactgctcaaggaaataaagaggacacaaacaaatggaaaaacattccatgctcatggataagaagaatcaatattgtgaaaatggccatactgcccaaggtaatttatagattcaatgccatccccatcaagctaccaatgactttcttcacagaattggaaaaatccactttaaagttcatatggagccaaaaaagagccctcattgccaagacaatcctaagccaaaagaacaaagctggaggcatcatgctacctgacttcaaactatactacaaggctacagtaaccaaaacagcatggtactggtaccaaaacagagatgtaggtcaatggaacagaacatagccctcagaaataacaccacacatttacaaccatctgatctttgacaaaccagacaaaaataagcaatggggaaataattgtctatttaatagatggtgctgggtgaactagctagccatatgcagaagactgaaactggacccctttcttacaccttatacaaaaattaactcaagatggattagagacttaaatgtaaaacccaaaaccataaaaactctagaagaaaacctacacaataccattcaggacataggcatggacaaagacttcatgactaaaacaccaaaagcaattgcaacaaaagccaaaatagacaaatggggactaatcaaactaaagagcctcagcacagcaaaataaactatcatcagagtgatcaggcaacatacagaatgtgagaaaatttttgcaagctacccatctgacaaaggtctaacatccagaatctacaaggaacttaaacaaatttacaagaaaaaacaaccgcatcaaaaagtgggcaaaggatatgaacagacacttctcaaaagaagacatttatgcacccaataaatgtacaaaaaaaaaaaactcatcatcactggtcattagagaaatgcaaatcaaaaccacaatgagataccatcttatgtgttagaatggcaatcattaaaaagtcaggaaacaacagacactggagaggatgtgcagaaataggaatgcttttacactgttggtgggagagtaaattagttcaaccattgtaagacggtgtggtaatgcttcaagtatctagaacaagaaataccatttgacccagcaatcccattactgggtatatacccaaaggattataaattattctactataaagagacatgcacacatatgtttattgcagcactatttacaatagcaaagacttggaaccaacccaaatgcccatcaataatagactggataaagaaaatgcgacacatatacaccatggaatactatgcagcaataaaaaataattagttcatatcctttgcagggacatggatgaagctggacgccatcattctcagcaaactaccacaggaacagaaaaccaaacactgcatgttctgactcataagtgagagaacacatggacacacggaggggaacatcacacaccagggtctgtcagggggtgggggcaaggagagggagagcattaggacaaatacttaatgcatgcagggcttaaaacctagatcatgggttgataggtgcaggaaaccaccatggcacatgtatacgtatgtaacaaactcgtactttctgcacatgtatcccagaacttaaagtaaaatttttttaaaaaaagaaaaatccttaagtaaaactgctatgctcttttttgtgggggaagaaaagagatctgatggttttaaagtgtgtggaagtttccccttctctctctctctcccaccatgtaagacgtgccttgcttcccctttgccttctaccatgattgtaagttcctgaggtctccccagccatgtggaattgtgggtaaattaaacctcttttctttattatccagtctcaggtagttctttatagcagtatgaaaacagactaatacaccacctgtaatttgtttcctgacttttaatgtcataatagtcaaaatacactaggctatattacagcaggagatggtaaactgtggcctttcagattatcaagtgcagttttaaactaagatttgtttatacagttttaagagccatagcaaaggaggagcaggaggtggaggaggtgtagaaggacgaggaggatatcagacccctatatggccttcaaagcccttttgagaaaaagtttagcaacccctgcactatagtaaccactaatgccaatgtcaaagtggttttcttctatgttttcttttaggagttttttggtttcatgtcttacatttaagtctgtagtctattttgaagtaatttttgtgtatggtataaaagaagggtccaatttcatttttttttgcatggaaatattgaattatcccaacataatttattgaagagtctgtctgatctctattgtgtatttttggcacctttgtcaaaaattagttgactgtatatgtttgagtttatttctgagtttactattctgtcccaattgtctgtgtgtctgttttatgccagcaccatactgttttaaatactacagctttggaatatagcttgaaatcaggaagtgtgatacctccacctttgttcttcttaatcaatattgctttagctactggagtttttgatagttccaaatgagtttgagagtgtttttctatttctgtgaaaaatgccattggaatttgataccaaaagacaggtaacaaaagtaaaattaaacaagtaggactacatcaaactgaaaagtttctgcacagcaaaggaaagaaccaacaaaataaaaaaacaacctataaaatgggagaaaatatttgtcaactatatatctggtaaggggttaaaataaaatatatataagtaactaatacaactcaatatcaattataataataaactgattaaaaaatgggaaaaggacctgaatagacatttttttcaaaagaagacatacaaatggccaacaggtatatgaaaagatactcaacatcactaatcatcagggaaatgcaaatcaaaaccacaatgggatattacctcatacctgttaggatggctattaaaaaaagtcagaagtgttagtgaggatgtagagaaaagggaatctgtatactgttggtggaaatgtaaattgatatagtcattatggaaaacagtatggagcttcctcaaaaaattaaaaatagaactactatatgatccagcaatctcagttctaggtatattcaaaggaaataaaatcattattttgaagagatacctgcactgtcatgttcattgcagcattactcataatagccaagatatgggatcaacctaagtgtctattggaagatgattggataaagaaaatgtaagagagatgtgtgtgtgtgtgtgtgtgtgtgtgtgtgtgtgtttgcatgtatgtatgtgtgtgtgtgtgtattggaatattattacatatttttaaaagcttttaaaaagaagaaaatcttgccatttgcaataacatggatgagcctgaaggacattcggctaagtgaaataagccagacacagaaagacaaatactgcatgatctcacttatatgtgaaatatgtgaaatctgaaacaacactgacctcagtaacagagtatagaacaggctgagggatggggaagaaagggaggataccggtcaaagggcacaaatatttagttataagataggacacctaatataaagcatggtgactatagttaataatcatgtattgtatacgtggaatctgctaagagagtagatctcaagtgttcacaccacacacacacacacacacacacacacacacatacacacacaccacacagtaacagtgagatgatgggtaagttaacttgattgtggtaaccatttttctatgtagacacatatcaaaacatcgtgttgtataccctaaatatatgcaatttgtatgtgtcaattatacctcaataaaactggggggtggggaactaaccccaaatctcagaagcttgcagcttgtaagaaaaaaggtttacttctcatgtatgccacctgctatgtccctacccaaatctcaccttgaattgtaataatccccacatgtcatgggaggggccaggtggagataatagaatcatgggagtggtttctcccatactgtccttgtggtagtaaataagtctcatgagatctgaaggttgtataaatgggagttcccctgcacaagctctcgcttgcctgctgccgtgtaaaacatgcctttgctacgtcttcaccttctgccatgattgtgaggcctccccagccatgtggaagtgtgagtccattaaacctctttttctttataaattacccagtctcaggtatgtctttattaggaacgtgagaacagactaatacaccacctaccatcttgggtctttactccaagtcttcttagtctggaaaggaggctgatagagtagtcacaatgctgaacactgtcacacattgtggcagaggaaaagggctccagagagtcttgcattagcaatttaatgctccagcttggaagctaccatcaaaactcactggctggaaatagtcactcagccctaccaaaaaaagagaagtacagtcccactatgtactaggaaggcaaagaaccagaaatacttgacaaatagcactaacaactaaaacaggtctctgagaattttttgttatatccacacctgaacaaattgaaataagattcttttctttagaattacaaaaaagcttaagtatagaaaaattgctggagagggacttcaaaattagactggagtcagattatgaagagtcttgtatgttttgctaaagagtttatgattttttctgtgttcaatggaaagtcttaatggacttaattcaatagaaaaagggaccactatagttcttagccaagggatcacttgattagatcggtattttagaaatgtcactctagctaccatatggaaatactggatgatttattgaatgagcgaacatgttgaaatgggaggccaattaggaagttactgcagtgaacaaggcacgagtagatgtggatttgaaataatgcagtgttcatgggaatgagcaagacaaactagattgaaagaaaataacctaagaagtagaatttacaggacttggaggaagcctgagatttacagcttggacagctaagtgggtgttaagactaatcattttgttaggaatgtagaggagacaatagtacataggccttgtccatcatgcatggtctctgaaaattctgagattaacttttgacctaataccctgcctacatttcttgcttcttggatcagtaaggaataaacttcaagtcctcttctctgttcaaattgtgatcctccagaaatttaagtgccaagtggatagcattcccagattttcactatacaagatgccattttgaaatgagttgtggcacatgatggggtctatatctgatttatttcttcagtccatactgactactagggcctcagggttttgtcataaaattgggcatgtgaaaatggaagttcaggttgccacagtttagttcagatcttctctctggaataaattggagacggaatttaatgtttgacattagttatttaaataaattaatatatatgaaactgatagaaacatggatttttttaacagattgaacacaattcttttggtaatgctaaagatacaaattatggcagacagaggacaaaattagaggagatctcagatgcttgtgcagagatggatggaaatccattagtctaccattactgaagcaattttcacagtgcattaaaccatgtactactaatgaaagtcaaaatattgaatgtatcctttaatgtcactgtacatgtatgtattataatgtaatattaataaaccacatattgtatatattcttctgtgtttctagactttgtggtccctgtttgtaagctataataattgcaatgtcactcagatgtcattttcctttaacatctgtgtggatcatgttcaaggatggtcattctaggatccatttcttatctctgttcatagaaagtgaaattccaaaaaccataattcccagcctcctttgcaaactagtggctaaccaggttcaaccaatgggaggtgatgttggaaaagtggagggcagaaagaaaggagcagccaggatattactgttcctctctctccctttcagatagcatcttgtctgcagctgcattccctgcatgttcccagctcctactggatatacacttcctctgtgttcctcattttctctggacagcctctcctttagctccagttcccactgagtagctacactcccaggattccagcttttgcctgacagtccaagatacatggtccctgggccagctcctcctcccaggtttcatctccctccaagcatccctaactcctgggcactgataatgtgcctgttctcttggtccccccagttctagcagtaatagcaccctgttaccattgttaaactctgaggtggcttacctttccctattcactctcagctcctccaacacctctgtgactagatccccatattaaaccccatttacagtggtaccttggaaaggatcctctatatagtccagaaagcgggactgtagtctgcaagatggcttcaaggggatattgaaatctataaggatgaatcagtggcacagacactaagggacaagattctgcagtcaggctgtggtggggaagaaagtacgactctaagaggatttttgctgaatggatatttcagaagaaagatgagacaaagctctgaatgggctcttttatctcctcctgccccatccccttctccagctttcaatatgaacattctcagagcactgtctcaaggaaaaatggacaacccattaacactcctattctccatatccttacaccaaacatgccctaagagaaaacttggctgcttcctctgagaataaaattgaaaaaaagagatattaatatattaataaattactgagagctaaatcagtgtttaaacaacatactttaaaagcaatcttttgatgcctcgtgtaggatggaaaaatgagcttatctaacttcagttaaattgcctgactctagcatatgtctgattttttttggacaggagacaacaacaccttttactaaattcaatggacttagaacactcaggcaacaataattcagaacatggacaaaacagtagagtctagaagtaaacttgtaggcttatgaatccaacaggactgggtttgaatcccagctattctgcctactagctttgtgactttgctgggtgacctaacctaaatctctatgcctcagttttccgagctttaaaatgaggataatagcatctacctctttggatagttatgaggatttaaagagataccttttgtaaagtattattagaatactcttctctgttctcaggaagagctaagaaagtaaagagctgaagaaacttgaaggcttagcattagtgactcttaaccactcaaatgagtaagaattactggaggagtttgttaagaatgtgggatattatgctctgctccctgaaattctgattcaagaggtctggaggtgtatccttaaaatgtgcatttttaatacatttatacccaggatttgaatgcatgtagaacaaagatcccattatgagaaacactttcatttgttacttcattctttatctatttgcaaaatttcctttaaatccactatttcctttaccttcatgatttatctaaattctaatgttttctcagtgcatcatctgcactctgccaactctggcaacctggacatgggtagtggttaagccacttactgaccagatagctttgaataagtctcttcatcgcttgaaaccttagttttgtcatctagagtgagataataatatttgtcctatacacctcttgggttactaaaagcatcaatggaggaaaagggtataaaagcatttttaaactacaaggcactataccaatgtgagttattattatatggggcctgtttgattacaatctcaactgaggtataaaatggaagggttttatttttccttacctgatggtatctgtgtggtgttgtcaaagctcatctttatcactatagagcaagctcttttaatatatctcatttcaatcccatgacttttcagtcattattggttattaaaccagtcttattttggtcaagtcttagttttgcccatcttcaatttcacactcagcccaaacaggtttttcttctcccttactctgcacagactagatttatggaaccagcagcacagagggaagggggtatgtgtgccaacacctcatcttctatcccaaaccctgctcttgctcctcttccttcaacagggagggaggaaaaagtaatgtgttctatgtccttagatcacagcaccatgatgcactggctgttctctttatgggtggtaatggccacttccttgtgtgaactaccctgtgtaacattgactatgtggctcttttatttttctttgtcatgaaagttgatagctcatggtctacagttgtaggcttttgcagacccccgaaaagacaaaccaggtgagaagctccatcccaaccagcttccctagtatcaattacttctcaacggatttgctcccatgttcctgctggtagcactgagccacatcaccttgactccagcccatttgcttcatacctagatgggtctcacacaaacctgaggccctaactcttatcatttctctccaccccagttctcgtgccctattgatataggaggtagaaatgaattatttaggcagatagtgagggcaaaagtgtcctcagtggattttttccttctaaccaaaagcagccccccaaattattacttttctgactgaacagcctgaaaaattcagctgcaaacataaataaggaagcaagatgcttgcatgggggaatgctggaagaagcgccaatagaaaagggctgtctggggccaggcatgtccaacatggaggcttggtcttccctttttttgttaccacgtgtacagtaatagatacatgggcatcatgacacagctcagacagagaacctgcctgcataataaaagactggggtaggggcagccagagattcctgccctatgcaaacacacctggtccaaccagtttttcgcaccctatgtaaatcaggcactgcctccccatcagctcatctataaaatgccctgcatttcaccatgggtccagcaactcatttctccaggacccctctctgcagtagagagctattatctttctttaaaccactcttaacctcactctttttgtgtccgtgtccttgttctccatggccatgagacagtgaatctccggtgcttgtccagacaacgaagctgtttcactatgggcatagattggatccattttagggtcataccatcaatctattcagcaatgccttttcccccacattgggaactcaaaggtaggcagtgagtctgactgctcagtgaacaagcaagtggtgaaggatgatgctcatctttcctccttgaaaaaccactaagctttcttttcttttcttttcttttcttattattattatactttaagttttagggtacatgtgcacaatgtgcaggttagttacatatgtatacatgtgccatgctggtgtgctgcacccattaactcgtcatttagcattaggtgtatctcctaatgctatccctcccccttccccccaccccacaacagtccctagagtgtgatgttccccttcctgtgtccatgtgttctcattgttcaattcccacctacgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaacagtgtcaaagtgttcctatttctccacatcctctccagcacctgttgtttcctgactttttaatgattgccattctaactggtgtgagatggtatctcattgtggttttgagttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggctgtgaaaattttctcccattctgtaggttgcctgttcactctgatggtagtttcttttgctgtgcagaagctctttagtttaatgagatcccatttgtcaattttggcttttgttgccagtgcttttggtgttttagacatgaagtccttgcccatgcctatgtcctgaatggtaatgcctaggtttttttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcctgtttttctcaggtttgtcaaagatcagatagttgtagatatgtggtgttatttctgagggctatgttctgttccattgacctacatctctgttttggtaccagtaccatgctgttttggtttctgtagccttgtagtatagtttgaagtcaggtagtgtgatgcctccagctttgttcttttggcttaagattgacttggtgatgagggctcttttttgattccatatgaactttaaagtagttttttccaattctgtgaagaaagtcattggtagcttgatggggatggcattgaatctataaattaccttgggcagtatggccattatcacaatattgattcttcctacccatgagcatggaatgttcttccatttctttgtatcctcttttatttcattgagcagtggtttgtagttctccttgaagaggtccttcatgtcccttgtaagttggattcctaggtatgttattccctttgaagcaattgtgaatgggagttcactcatgatttggctctctgtttgtctgttattgatgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcccgcctaactgccctggccagaacttccaacactatgttgaataggagtaaaaccactaagctttctaaagtgattttctcatccacgtccacccccccaggaacggaaacaaaatgagtcccatctcaccctatccccactccccaaagagaagaaaggatatattcaagtgtagttccattaaactggcatttctcagcaaatcccataataggtgagagtcatttggctgaatgtgagagtaacagggtgtgttttgatctcaggtaaaggttattaccaattcctcaaaaattgaaaagtcccacacaggaccccttaggagctcttacatggtaattatcaatcatagcctggatgtctcaggattccccagatgtaaggttgtggttgttactagggctattcactgatatatcttgtctcttcctttaagtacatgttgggattgtctttccttgccccttttaaatttgatttggtcatgagacttgataggacctaagaaacatgtgtcagttctgggctgagaaatttaggacccactgggccatcctcacattcctgttttcctgtctctagcaagccagtagcaatgttccagatggtccagcctccatcagattggattgctgagaatacctttgatggacatgaagtgcaatgtggaggttttgatccaagacttttggactgtcactgcagcataatctagactaggctgaatacaaagggatgagtggaagtgtaaacactgaaaaagaattctcaaagacaatccacccagttcagtggagtgaatacacaatgagtaggaagagtgtcataaacctgcctaatcttaaaagacctgagaatcaccgagaaggggagcacattgcatttgtctagagaagataaggaacaatcccaatgactacttttattagcagtcatcaaatttctcatgtatttgcataactgtggcatgtggtcccatactgtggatattctggttaaagtagagtgaatgccagtggaggagagatgcacgtgtttggaaactcaataacagtttatgtaaatatgaacaatggaaacaatttatttcccttattgaagagtttggtgttgttttgtttccttcaactggcaacatttgataaagttgcagaaatgggaaatttcaaaattttgataatttagaaagactgtctatttatttatttatttatttatttatttatttatttactgagatggagtcttgctctgtcacccaggctggagtgcaatggcatggtcttggctcactgcaacctccacctcctgggttcaagcaattctcctgcctcagcctcccaagtagctgggattacaggcgtctgccaccacccagctaatttttgtatttttagtagagacagggtttcaccctgttggccaggcttgtctcgaattcctgaccttaggtgatctgcccaccttggcctctcaaagtgctgggattacaaaaagactgtctttttaaaaagcaataaaacttaggaaaaagaaaagacaagcccacagatggataaaatatttgcagtacacatatctgataaagaacttgcatctacaatatacaaagaactcataaaactcaacaatagaaaaacaaaactcaaataatggccaaaagatctgaatagatgtctcaccaaataagacatacaattggcaaataagcatagaaaaagatgatgaacatcaaatgtcattagagaattgcaagttaaagcaacagtgaaatatcactacacatctatcagaacggctaaaaaatattgacaatagcaaatgctgctgaagatatggaacaataggaaccttcattcattgctagtggaaatacaacatggtacagccactccagaactggcagtttcttacaaagatacacgtagtcttaccacatcatccagcattatgtccacacaaaaacccgcacatgaatgtttatagcggctttattcataattgccaaaaactggaggcaaccaagatgttcatcaacaactgtggtacatccatacgatggagtattattcagctgtaaaaagaaatgagctatgaagtcacaaacaaacattgaggagactttaaattcacacgctaagtatgatggttaatgtgtcaacttggctaggtcatgggaccccggtatttggataaacattattcaaaatgtttctgtgaatgtatttttttttagctgagattaacatttaaatcagtagactttgagtaaagcagattaccctttataatgtgggtggatctcctccaatcagctgaaggccttaatagaaaaagactgaggttccctgatgaagaaggaattttgccaggagactgccttcaaagtcaaactgcagcatcagcccttccctggatctccagccagccaacttaccctgcagattgtactgtatgattctaaccatgtgacattctggaaaaggcaaaacaatttgacagtgaaaatagaagcagttgccaggggctcagagaggtgggggcaaggatgaataggtagaacacagaaactatttattaggtcagaaaactcttctaaatgatactgtaatggtggatacacgacattatgcatttgtcaaaatccatagaacgtacaacgccgaaccttaacacaaactatgaattccatttaataatgtgtcaatattggttcatatttttccacatctaagctagagataataaaatgagacttagagagttgtcataaaaattaaatgagagaatatgtgaaaagttctgggccttgcgactggctcaaaaaatggcagagatgtaaccatgtagatgatgctcagagaaagaggaggagaggaaaggaaaaaaggaaggaagaaataaccaatttcagggcagatgaaggcttcagaatattacaggtttttcatattcagttactgtcattattaccttcagcaacataagaccctagattataaccagtataatcctacagcttagaaaaaaggatagaaaaaaaagtaaaatctttacaaaataatttcaaattacatgtgagtcatattgaaactcttcctttttataccagagagggaaaacaccatctaagcttccaatgaaaaaaaaaaaagtctgaacatgtttccagaataaaactgtaagtttgaggggaaagtggatatttggtctcagtttccaccttcactttcactttaaatagcctggaagaaaagttaaaatctaatcagaacatattagagtttgggtgtttttgaaagaattaagattttagcacgatttttcttaattattttacaactttttttcctccctgatgcgaatgttatgccacatagaagctgaagagccaggtagcatgccccagtttcagcaaaggctgaaaaactttaattgtcttcaacgaagagtcctttgccctggatttgctggataatctctattttaagtggctcttcttattattctgtctcagagactgtgtttcaaagccctgattttgcctgtatgccaaactgtaggaagtcatatgatttggggctgaatctactgcacaaggtctagtatttaaaatgctggagaaaacattttaatagagaagacttagaaacatactacctcatttgactggacgtaggcatgtagagaatttgtcccaagccccaaagctagtttgtgataagccaggatttgtacctagatctatgggacttcagagaccacactgttaatgacacttttcatttctgagctcttgaaccccaacacccaagtgattgtttttgagatgaatccctttccaaaagtacagaagtacagttcagggggcaaaattaacctaaagggaatccctttctttggccaaatccatcaagaactctaaaacatatcaaatgcacagtccaaacacctgaaatcctctttcctcacctaccttcacagccaactgctctgtaacaaatgtcagactatactcccaactcctccttcatctcaggccactagtagatcagcttactactgtaggcctaaatcctttacctttccctccattctttccattttactctccactctccccccactctcccagcccctttttcttaactctgcattcccaaagccccaagaacctgtcttctgaagtcagagcttccctaagccaaaagtgtctgagaacattttattttaagcaaatgtggggaggagagaagagtggagcattctcaaattgtaaatcctaatattttgccttttttttttttacacttgtgagatctcctaactcagattctaaatctcactcatttctgaatctttcatatatggtttctggttgctatcctacattacatcgcaagcaactaccctatttccaacattatctcttcgggctttgtgataagactttgtaccctaaaaatcctaagtaacccgttttcaataattacccctgggacactcatggcactttttattagccattatggcagattatgttttccagaaatggctgcaatgatacatatcccattccacatgctcttcttacagtgtgaccttgacactcctccatcaggcattagggtcaatgttctctccctttgaacctgggcatacttttgtctctaccaatagaatacagggaaagtggcagtgatttccaaggctaggacataaaaggcatcacaatttctaccttggtcttgggtcactcacactgggaaagccagctgccatgcattgagaactctcacgcgacatagtagagaggaatggtagctccaaccaacagccagcatcacattgtcaggcatgtaaatgagtcatgtaggatgtaggtccttccaccccactcaagccttcaaatgactgtagccctggccaacataggaccgcaactgtgcaaggactaaagcaagaactgagcaatagaaactggaagtaataatatatcaatattgctgttttaagccaccaaattgtgggctgatttttttgcagcaatacatcaatatactagctattctaacctaatcttaaatttatcccagcattacatcaattcagatgaattttaatgtatctttcagggaaggaagagtttcaaaaaaattaaggccagaatggaggtggggtggggttctcttattgccccaaaagaaatagggagcactgggaccagagaaaatgccctcaaaagatgagtgaattcagaaaatagactacttttacttttcagccttttctgagaccctgaattgatatagttgctgtggccaagtcctaattctctggatgataaagaatatttgatcatggggtgagaattcaaatctttctaattaaagccccaaatgaactctgtatcattcaggataataacattaacagtctctgaattttcttctgtattgggggaaaaattcattcccaggcatgagccaatgtgggcttctgaaagcctactattaaagaatttgagaacccaacaataatctgatggtgacttcaaggtcagggaggcactgatcttgctttgcagggacacaggctgggctggcaacatcaacagtcactgaaggagggctgtggcatactgtccagagggatcagacagcctatggaaaaatgatgacctgccgaataagcttcagtaggaacgggaggacaagatgccctatatttgtagagaaacagttttcctcttcctcctcaggacactcaggttcctgcttattactgcccagaatgtctcagtgaacacgaaagggggcctgctagataccactggaaggaaaaaattggtgctggtgattaatttcccgagactctaacttctacctgaaactggggtatttctccctttaacttgaacacagcaaacagctatttgggggaagatgcattttgagatatgtttccaagtcaggctgaccccttttatctccaaggaataaaggatcactcaggtttcctcaagccatgggagttattagaagaacaaataaggaaataagcaagatagcataagagctatgactgcttcttgacacacaaacacaggaaacatcacattccctaatttttctaaattagatcaaatctaatatcaccaccccccattaccacattggtaaaaatctaatcttagtcatttcagagaaatggataaacaagaaccttggaacctatggaagtccagtgaggttggggaagagattccaatattcataattcataatggacagcagctagaatgttccttgactaaattcccccaaattcattcagatatgctcatggcatccactcactttaggatttggctcccaaagtcacagcatatagtcctcacgctccagacacgcacatgccaccactgtcatagggctgcctcccctaggtgctgcatggagggatatacaccctcccttctaatcccaattatggaaagcccaactcttgctcatcaccccctgccctcaacccctagaagcctgtccttttgacagtggcggtagctggtgagagtactcagtctcagatacagataataagatggtgtcttacctatagaaaatgtgtaaacaataataaaacccacaagtctgtttttttttttttttttaattatcaccttgcaggcaattttaaagtgctcatttctgcccagcggcagaccattcctacttctcatccttggtatggccactgccttttgaacagtcaagaattatgttcttatgagcctagagttggaaaaaagtctctctgtgtctctctccctctctttctttttttttttttttttttgagagaaggtctctgtcacccacgctggagagcagtggtccaatcatggctcactgtatccttgaccacctgggctcaggtgatcctcccacctcagcctccagagtagctggcaccacaggtgcacaaaaattaaaatttcaactttttgtacatgaagaactttataatctggtatcatgcaaagaacaggaactataatacctctggcttcatgggaataagaacctgagctgtccagttaatcctcattattcttgttgcatggagatttcccacttggctgtttgcctctgacccaatcagtggtgggataggttcatagggtgctccgatgttgatttatgaggaaggaccctcgtctaagtggaatgcaggtttggtagatatagtaagatttaacctacccaacagagtttcaatttgttgggtgcctttcaaggtgggcaggtcagggaaaaggatggggtctggagtggcacactccatgagctctgtgaaatgcctttacatgtggcttggatgattgaacaaggccatgtcaggtcagcatccagggctaaatacctgctactgccttggtaggaaacttctttctgcctcaaattccctacccagaagggaggattaataccttcaagataagtcctcagaggatgtctgaccagataacaaaaaggaataagtgacttccaggatagaggatacttatctatttcataaattaaggtacatagcttatttcatagctattactaagcttaaggtaccatttagtaaggaggaaagatgaatttaaagctgtgtatttcaaagggtggtccgtgaaccaacatcatctgcatcaactgtgaacttgttagaaacaaccttagttgttttaaccaaacaagaatttggagatgtttattactgcagcttgtgtatactattctaactgatataactacaaatcgagacttgtgacatggaccaaaactagtgcttcaaacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgccggagaggatgtggagaaataggaacactttgacactgttggtgggactgtaaactacctcaacccttgtggaagtcagtgtgacgattcctcagggatctagaactagaaataccatttgacccagccatcccattactgggtatatacccaaaggattataaatcgtgctgctataaagacacatgcacacgtatgtttattgcagcactattcacaatagcaaagacttggaaccaacccaaatgtccaataatgatagactggattaagaaaatgtggcacatatacaccatggaatactatgcagccataaaaaaggatgagttcatgtcctttgtaggggcatggatgaaattggaaatcatcattcccagtaaactatcgcaagaacaaaaaaccaaacaccgcatgttctcacttaccggtgagaattgaacagtgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaactttaagtataataataaaaaaaaaatttatggctctagatatatatataagaaaaaaaaagaaaggctgaaaattaatgagctaagcaattagttaaagaactaaaaccaacaacaaccacatagactcaagggaaatagaagaaaaaattttaaagcaaaataaaaaatataaggtttaaatagagataattcattaagtcaaaagtcagttctttgaaaagactagaaaagtcaacaaatctctagtgagtctgatcaagagacaaacagataaggcaaaatctgaaaaaaagttatttgggctagaaaggggctgtattgatcaggataatgcaaaccagacactcaaaaaacaccccaaatctctgtggcctaaaatattcttatcacaaaccagtgcaggtcagttagctctgctgggtgactgtcatccaaatgttgaaacagacttcagaattgtccccactgataggaacagacaactgccaccagagcaaccaggaccagggtggatttgaatggtgcacctgaacttccagaattctagcccactggcttttcgggcttgctcttatcattttattagtctggaaataatgtgaccccacattttatgtgcttaaattttttggatcctgatatggttaggttttgtgtccccacccaaatctcatcttgaattataatctccataatccgaatgtgtcaagggagagaccagatggaggtaagtgaatcatgggggtagtttctcccatgctgttctcatgacagtgagtgagttctcagatctgatggttttgtaagggctcttctccccttttctcggcccctctcctttgtagcaacttgtgaagaaggtgccttgcttccccttcacctttcaccatgattgtaagtttcctgaggcctccccatccatgcagaattgtgagtcaattaaacttctttcctttataagtgacccagtctcaggcaattctttatagcagtacgaaaacagactagaacagaccccaagtattgtttctgatatggccatgttgtatttgtgaaaaaaactaagtcacagaaccatttattacatgtcaccgttttttaaagcttgaaaacaaccaaaatgagaaaatgtattgtttagaaatgtaagcaaatagggtaatattattttgcaaaaataataaacacaaaatttaagagtgcagttaacttgagagtatattcaggcaaattgaattgttttaatactgttctagttcttgagtcagatagcatgttttcagtatcctttttattatagtattttatgtctaactgtgtcctatgtgttcttctgtatatattaagtacttcctctatttaccctcagtttccactttgatttttgaccttagcttctcaatttctcagcttctccatctatgaagtagggatcattacattagcttctacttctctcattgggaaagggtaaatgactacagtagttccctcctcatccatggtttagctttccatggtttcagttacccatggtcaactgtggttcaaaatactaaatggaaagtttcagagataaacaattcataagttttaaatggcacactgttctgggtattgttataactgtcctattttattcctagtttttgttaatctcttactgtatctaatttgtaaattaaactttatcatagttatatataggaaaaaacatagtctatataaggtttggtactatttagttttgggcatccactgggagtcttggaagacatcttccacaggcaaagggggactagtgtattttgagatcttagtgcaaaaagtatccatacatttcaatttcttcagcttctccaaaaagaagcaggcttaggacagtggagaaaagacatgatgttgtgttcctgttgcaatgtggctgtctagttaatgatctcatgatcctcacacaggataggctttttgtcctctgggtgaattttgtagaggtgtgacaccctgggctttgttacatgtgacaatttattaaaaatgagtttcccatatttgcatagaagggaactgtgggacaaaaggcaaaaaaggaaagaaacagagagaagacaggagggaggtaggaaccagggtaagaagaagagcaagaccaaccgtctttattgaatctacttccctcctgtgagctccagggtccttgtgaaaagctaaagtacttttccctgtctaatttgacttgctcatccaagaactggtaattctgttaagcaacaagcaggcactccatagcaaagaccagaagtcgttaacttgtgcccaagacctgtctccccacttctaagaatacacttcagcggtcccagagaaagaaatgatacttttaatgttaatacacaaaacaggaaacaaccccagtgtgtattttctggataattctagccaagagagttaatgagcaataatagttttaaaggctagagcagttggggcaatatttattcatctgtaacagcctatgaaatacaaagtataaaacaaaaggcattacagattggggaatttaaacaagcagccagtgaggctgagtggagcttttcagagaagctgtaaaatgtactccgatgcataagaggaaaattaaagatcaaaaggacattatcatattcaagcggttctgcagtacacagcctcacctctcctggactttgagagaaaagccgtcagtggtaataattaaggaagcctgcacttgtttttttaataaatatttcatgatatgtcatctgcttctgagaggagccataacatgccacagccactgcatacttagcagtcgtggaatgacaaaaactgggctaattatgctaagatcatacaaatttagaagcgaagacagtgaaagctgacaggctatgtcaagggctatgaatttgggttatacacagaactccaggagttagcagtgtcagcttgttatgtgccaggcacccctgcaggtcttactcactggggcacccttgcaaagagttctaaaaaacaccttttggcaagaacagcacttcagaggctttcagacatgagtggaccaaagccagaagagcctgcatcccgcctttcccaatggcagagagaccttaagactcagactgcaaataatcctgcctgttttgacctctttgagtgaggaaaatttcttaatctctttgaggttctgtttcattattcattaatttcccaaatatgtattgagcacctactcagtatcaggcactggcactagacattggtagcatagctctgaatcagacaggcatgtgtgccctggtggcggtctcattctagagggaaagacaggtaagaaacaagtgaaatatgtaatgatgcatgttaagaagaaaggtaaatcagggaagggggatcagaagtgttggagttgggtgactgggaattgtttttttttttttttttttttgggttttttttttttttgagacactcactgagaacgtcgtagatgaggctgaaggaagtaaggaaaagagctgagaggatatgtgagagccgagaaccccaggcagagtggcagcaagcacaaaggctctgtgctcagtgtgtcagagaaggagccaggctgcaagaaggcagggagaagagtcaggtagggtgaggttaataggagatgaggtcagagaggccatgaagaggtggcagatcacaaaatattcatagttaattgtaaggacttggattttatgctgatgagataagcaaccatcagagggttagagcagaaggacaccgacatggcttgatcctgtatccccacccagatcacatgttgaattgtaatccccaatgttggggtagggacctggtgggaggtgattggatcatggggtggtttctaatggcttcgcaccatcctcctagtgttgtctcaagtgagttctcaccagacctggctgtttaaaagtctgtagacttcctagttatttcttgccttctgctagcttttgaatgtgtttgctcttgcttctctagtttttttaattgtgatgttagggtgtcaattttagatcttgcctgctttcttttgtgggcatttagtggtataaatttccctctacacactgctgtaaatgtgtcccagagattctggtatgttgtgtctttgttctcattggtttcaaagaacatctttatttccaccttcattttgttatgtacccagtagtgatgcaggagcaggttgttcagtttccacatagttgagtggttttgagtgagtttcttaatcctgagttctagtttgattgcactgtggtctgagagtttttgaaaagatcaacaaaattgatagaccgctagcaagactaataaagaagaaaagagagaagaatcaaatagacgcaataaaaaatgataaaggggatatcaccaccgatcccacagaaatacaaactaccatcagagaatactataaacacctctatgcaaataaactggaaaatctagaagaaatggataaattcctggacacatacaccctcccaagactaaatcaggaagaagttgaatccctgaatagaccaataacaggctctgaaattgaggcaataattaatagcctaccaaccaaaaaaagtccaggagcagatggattcacagtcgaattccaccagaggtacaaggaggagctggtaccattccttctgaaactattccaatcaatagaaaaagagggaatcctccctaactcattttatgaggccagcatcgtcctgataccaaagcctggcagagacacaaccaaaaaagagaattttagaccaacatccctgatgaacatcgacgcaaaaatcctcaataaaatactggcgaaccgaatccagcagcacatcaaaaagcttatccaccatgatcaagtgggcttcatccctgggatgcaaggctggttcaacatatgcaaatcaatagatgtaatccagcatataaacagaaccaacgacaaaaaccgcatgattatctcaatagatgcagaaaaggcctttgacaaaattcaacccttcatgctaaaaactctcaataaattaggtattgatgggatgtatctcaaaataataagagctatctatgacaaacccacagccaatatcatactgaatgggcaaaaactggaagcattcccttcgaaaaccggcacaagacagggatgccctctctcaccactcctattcaacatagtgttggaagttctggccagggaaatcaggcgggagaaagaaataaagggtattcaattaggaaaagaggaagacaaattgtccctgtttgcagatgacatgattgtatatttagaaaactgcatcgtctcagctcaaaatctccttaggctgataagcaacttcagcaaagtctcaggatacaaaatcaatgtgcaaaaatcacaagcattcttatacaccaataacagacaaacagagagccaaatcatgagtgaactcccattcacaatttcttcaaagagaataaaatacctaggaatccaacttacaagggatatgaaggacctcttcaaggagaactacaaaccactgatcaacgaaataaaagaggacacaaacaaatggaagaacattccatgctcatggataggaaaaatcaagatcacgaaaatggctatactgcccaaggtaatttatagattcaatgccatccccatcaagctaccaatgactttcttcacagaattggaaaaatccactttaaagttcatatggaaccaaaaaaaaagctctcattgccaagacaatcctaagccaaaagaacaaagctggaggcatcacactacctgacttcaaactatactacaaggctacagtaaccaaaacagcatggtactggtatcaaaacagagatacagaccaatggaacagaacagagccctcagaaataataccacacatctacaaccatctgatctttgacatacttgacaaaaacaagaaatggggaaaggattccctatttaataaatggtgctggaaaactggctagccatatgtagaaagctgaaactggatcacttccttacaccttatacaaaaattaattcaagatggattaaagacttaaacgttagacttaaaaccataaaaaccctagaagaaaacctaggcaatactattcaggacataggcatgggcaaggacttcatgtctaaaacagcaaaagcactggcaacaaaagccaaaattgacaaatgggatctaattaaactaaagaacttctgcacagcaaaagaaactaccatcagagtgaacagacaacctaaagaatgggagaaaatttttgcaatctactcatctgacaaagggctaataaatagaatctacaaagaactcaaacaaatttcaagaaaaaaacaaccccatcaaaaagtgggcaaaggatatgaacagacacttctcaaaagaagacatttatgcagccaacagacacatgaaaaaaatgctcgtcatcactggccatcagagaaatgcaaatcaaaaccacaatgagataccatctcacaccagttagaatggcaatcattaaaaagtcaggaaacaacaggtgctggagaggatgtggagaaataggaacacttttaccactgttggtggggctgtaaactggttcaaccattgtggaagtcagtgtggcgattcctcagggatctagaactagaaataccatttggcccagccatcccattactgggtatatacccaaagtattataaatcatgctgctataaagacacatgcacacatatgtttattgcggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaacgatcgcaaggacaaaaaaccaaacaccgcatgttttcccttataggtgggaattgaacaatgagaacacttggacacaggaaggagaacatcacccactggggcctgtcgtggggtggggggagtggggagggatagcattaggagatatacctaatgtaaatgactagttaatgggtgcagcacaccaacatggcacatgtatacatatataacaaacctgcacgttgtgcacatgtaccctagaacttaaagtataattaaaaaaaaaaagtgtgtagacttcccccttcactctctctctctcctggccatgtgaagatgtgtttgcctttgccttccgccatgattgtaagtttcttgtggcctccccgaccattcttcctgtattagtcagagttctctagagggacagaactaacaggatagatgtatagatgtatatatgaaggaaagtttattaggagaattgacttacacgatcacaagttgaagtcccacaatagggattctgcaagctgaggagtcagaaagctagtccgagtcccaaaacctcaaaagtagagaatccaatactgcaaccttcagtctgtggccaaagggcggagagaccctggcaaaccactggtgtaagtcccagagtccaaaggctgaagaacttggtgtctgatgttaaagggcaagaagcatccagcatgggagaaagatggaggccaaaagacttacccaatctagtcttgccatgttcttctgcctgcttttattctggccatgctggcagctgattagaatgtggccacccagatggattgaaggtgggtctgcctttcccagcccactgattaaaatgttaatctcctctggcaacacccttacagacaaacctggaacaataatttgcatccttccatccactcaagtgactctcaatattaaccatcacacttcctgtacagcctgttgaactacgagccaattaaacctcttttctttataaattacccagtctcaggtagttctttacagcaacgtgagagcagactaatagaaacacaccaaccaacaatattccagcagcactactctggctgttatgttaagaactgaccacaatggggcaaagtcagaagtagcgagaccagttaggaggcttctgaaataatccaggtgagagacaatgatggcttagactagggagtagcagtagaaacccagatgagaggggttcagaggcagtgctggcaggattgttttcatgaatgtggaatgtcagactaagagaggattaaagagttaatccaagatttttggcgtgagcaattgaaagaacagagttaacactttctgagaagggttgtctttgtccatcagctgtaacagaatacctgagactgggtaatttgtaaagactataaatttatttctcatggttctggaggctgggaaattcaaggtcaaggggcccacatctggcgagggacttgcagcatcatcccagtgtggaaggtggaagggcaagagcacgtggtgggtggggaggagagggagccaggcttatccttttatcaggcacccactcctcactgcagtgataacacaccctttcctgcaataatggcattaatttattcatgagggcagggccatcatgacctaacacctcctaaaggtcccacctctcaacactgttgctttggggattaagattccaacacacgaactttgggcaataccatagcaaaggtgtaactggaaaaaaatcacacttagagggggaagaatatcacgagcttggcttagatcattctcatatgcctgagaatgttgagatattgagtgggcagttgggtatgtggatccaacatttaagaagtggtgtgagctcaatgtattaaattggaagtcactgatatctagctggtacttaaagccatgaggccagatgatattacccaagaagtgagtccaaatggaaaagagtacagaacaaccaaaaaatgtgtcccagggcattctaatacctcttcaaaatggtaaatgatgacatctgcaaaatggaagtaataatattgtatctcattgagctgtgaggtttgaagaatgaatacatggaaaaagcaccaagctcgtatgtcctagcacacagtgtaaatattaagtaaatttaaatgaagccaaactacccagttgaaggcaataattcctatcaaccagagcagataataaggcctagaagggtttaggtgtttcctgtttaatgtcatagtgcccaggagttttagagatgagatttaaacccaggttttgtaactctaaatcacgtattttgtctttggttgccacgtggtttcctgttgatgaacaagtcacatagctatcttcaaggagcttacactttagtagtgggagcgataaggcagtgtataaattttaaaagatttaagtgacagtccaaaatgtgaagagtcttagatcttgtgtcctacaagccctggctgtgggaaccctgggtctcctattcatgtccaggctgtgagatgtggcccagtcgatcctgccttcttgtgaggtcctcatggttattcatggagagacagttatgaagattttccctctctaattattaggccaactggaatactgggtctggcattactcactgtaccagcttggaattcaagaacgattttaggtgaccatcatcaacttctcctacttaaacacagtgcctggccagtcaagtctccttcatgggaaagccttacacttttttagcctttttgaacagtttctttgcatgctggtgggggaatgcctgtggatgaaagttttttcttttgctctagggacagagtcaggctggctttgtgtaagcaaagttggtaaaagcaacttgtgattaaatgacacattccaaggtcttgaagcttcctagatcagaactagaaccacatagaaatgccaattttgggtctgtggcagcatgtcatatggcagttggctttcacatcttcctcctttcattcttataataatgtgatagagcttgtggggcttgtattcattatcggtatcctcattttagagtagaggaaactggagctcagaaagattctacatcttgcttacagcactatagctaggaaatgatggaccaaaggtttgaacccaaactttcagattccacattatcagctctcatcataggaacatgctattgattactctttggtgatttgctgtcattgcatagcaaggtagtaaccagaccttctgattccatgatcccagtatatagtctacatactgcagtaacatgcaatctctcaggatcaaaacaatctttaagaagtgcttttcagccagatgtggtggcttatgcctgtaatcccagcactttgggaggccgaggtgggcagatcacctgaggtcaggggttcaagaccagcctggccaacagggtgaaacaccatctccactaaaaatacaaaaattagctgagtgtggtggtgggtgcctataatcccagctattcaggaggctgaggggggagaatcgcttgaacccaggagggggaggttgcagtgagctgagattgcaccattgcactcaagcctggacgacagagtgagactccttcaaaaaaaaaaaaaaaagaagaaaggaaagaagggtttttattatttttctaataaccttcctggggtgggatttataatggactcacacgatcctgaaattttctctacagtaagaaacataattttgatgttctgttttagaaatgctggttttcagtggccatagacattctccaacatccagaaacacttatctacacgatcccacagtatctttctcaaaaggattgatcgagtcatgggttttccttttcaccaaattgaatcagctgttgatttggcattattaaatgccacttaagagcctacacatgtaatgtctacatccgtaatccaccccagataaaagttctcaaatgtcagtagtcacccacatgctattcaaaaccccaaatccacactggtcccacactttcatgactgcctttttcactccccacataaacattcattgttttctaaatgtccttgttatgccagccaaaaataagtatccactcagagcaacccactcagaaaaagttttcacttcaattctttttccaaatgttcaaaggggggatggatatcacagaatttgagacccagcagctgattttgataaggcctattggattcatttttttcttccatataattggttaagaaagaaatataagcatttccctaactaaaaaccaaggcaagattacttagactatcccaagtacagtttgttctatagacaaaaaacctgcctcgtctccgtggaagttgattttttttttgtagaaattgatggaggatttgcaatcccgatatcctgctggtcacttctctaatatgctttaaggacaggagagaaaaccagcatcccctcaattagttctttcctggtaatattttatcactgtacaaatgggccagaaagtggctttgagctgaaaacctggagccccacaaagacacaacagtactatttaatgtctgccaactaaccaccaagccttggaatcatccaactaatgagacaaagaaatagcatggcactgagaatgctgtcggacttgctggtggatatccttcctgctaatttgcagtggaaaagcggggggcagggggacattaaaattacctctgtagtcattttatctgcagaaaaagtgaacttttggaagcaaggaagaccagtgttcactctgcctgccaaactcccatcacaccaacaagccatgcattcctgatgcccagcgtcacagacactgcaagcacctgcaactatttttcttccctatttattctgcctctttccttccttccctttgttctggggcaaacattagcagttaaacttatttagctattaaaattctcattctatgttttaagaagattatttatgggatggaaaaatatttataacaaataattagtgaaaacaggtttcaaaaaaagtaggtaatgcatgatcccagttttactgtggaaaagaaagaatgtctagaagaatatcaaaacattaacagggatctaaagagacattatgcaatcaggagtgattttaatatgcttttttttggttttaactaaatctttctcaattttacaaaagaaacatttggtacttaaaaattacacattatcaggccattgccatcaatttgacaaacattggttgcctacatactgtgggaccttgtaatgcatgctaaaataatatgaaaggaaagagggttccttgtcttccatagacttacagtctagttagttggccagaagacaaataatatagaggtagtcaaaatatggtgaaagatacttctaatttttaaataaacttataaacatagagtacttttagatatacagaaaaaattgagcagacggaacagagatctcctatagaatccacatccactttcctctattatcttcttatgttaatatagcacatttgtcataattaatgaactgatatttatacactactatgaactaattcccatcttttatttagatctccttagtttttcctctaatgctctttttctgttccaggatcccatccaggataccacattacatttagttgtcatatcttcttaggatcctctaggttgtgacaatttcttagacttctcttgtatttgataaccttgataaatttaaggagtacttgtgaggtattttgcagagtgtttctcaatgggtgatatggtttggctctgtgtccgcacccaaatctcatctcaaattgtaacccccatatatgtagaaagggacctggtgggaggcgactggatcatggggacagtttcccccatactgttatgtgatagtgagttctcatgagagctgatggttttgtaagtggtggttttgcctgctctctttttatcctgctgccttgcgaaaaaggtgccttgcttcctttcatctttcaccatgattgtaagtttcctgaggcctccccagccatacagcactctgagtcaattaaacctctttattaattactcagtctcagggaagttctttatagctgtgtgaaaacagactaatacaattaggagtttgtctgatatttgtctcatgattagactggagttactgttttttaagaggaagattacatagacaatctttcaccatatgatatgccactttcaccatatcatatcaaggatgcatgttttcaacatgtcttaatcactgttattgttaacctttgtcacctggttggctgagttattgtttgtcagttttctccaatgtaaagttactatttttcccctatccacactgtaaatgctctttggaaggaagtcactatgcatagctcacacttaagaagtgaggagtggtactgcacctgtttaagggcacagtatgcacataaattatttggaattcttctcatgggaggttttgcttctctacatgtatttgtctattcaattatttatgtatactagtatggactcatggatgtttattttatactgtgggtcataaaccaatactactttatttactttgttgctgaaattttctcagctttggccactgggagctttttcaccgcccctgtgacatgcccccagtgttgtggtgtgtgtgtgtgtgtgtgtatgtatgtgtgtgttttagcacttccttattttctggtattacaacatgctccaggcttatcttgtatatttcttgcctcagttctaaagtcagccatttttccaaggatccctggttccctttgctggagaatcatattagaaaccaagacttgggccctaggtgtgctcattgttactgaggtattgtttttaggctgtctcaattaacaaagtaaggcgatatatacagatctactaatccagctataaacatataagtatttctacatgtaactctctgtatttatactaggctaaacatacattcatactgatgctgctgagtctaattgattaccacgtggatcattctagccccctctccttgtttatttgtaacctcccactctaattaatagtaagaaaccaacaaaatcatcagaacctctggaaatagggtcaatatctcaacatgtttcaaagctcccagttattctaatatgctgtcagaattgagagccactgaccttgtcagattattccagtcctcattcctacttctcccattcctaggctttgtcctcaagaagtgtttgaaaatatctgttgcttaaatgaagttgaggctgaggtttgaggtgatgtggacatgctgtggacatggaaaggaaggaagagaagaatttgaggattaggagcagaagatgctgctagaaaaagaagagacaatcaaaaaagtcggacaaaagaagagaggtgaagccactgtcttcatgtacatgaactagatgtatataaaggtctttgctcaacatttttctatctacacagaagcaaaaggagaaaacacaggcaaaaattccagcaagtatgcttagctataaagaataatttcttcactgtaaagatgtaaaaatagagaacagtctgtgaaacactagcccctgtgaatctattaaaagctcctgcagacattgcgactgaattaggtcagctgaaaaatgcagtttagaaagggagttggaactgttaagagaatgtttttcagtctttcttcttccagacagcacttaataccctactggatcaagaccccctattctggtttgaatgtgtcttcaaagttcacttgttggaagcttaatccctaatgcaacagtgttgggaggtggggcctaataagaggtgattaggtcatgagggccctgccttcaagaatggattaatgttgttatcttaggagtaggttatttactgagagagtgggttcttgataaaaggatgtgtttgcctctccctttctcttatgccccctcaaactctcttgcccatccatattctccatgggatgatgcagcaagaaggccttttccagatacaggcctctcaacctttgaccttccagcctctagaactgtaagaaacaaatctctgttctttgtaaattacccagtctgtggtattctgctatagcaatatagaacagactaagccttctcccatcccagcaacatgattatttactgtgggttgcatttgtaggtaagatgggcaggtgacaccaaatccctgccgagctttaaccctttctctcccactcatctacacatgcctgtgagcctcactgtgtccccttattctcccaggagaatgcagtgcactgcctagtgcgggatgggcttagttggacatctgtctcaactgcagcatcttatgtcactctttccctttcctctgcagccacactgatctttcacttctccaaatatgtgctcttgctcaccatgagatttttgcacaagcagtttcttgcttctcctttatctagttaacttcttcccaaccgctcaatctcagaccaaacattacttcctcagagaagccctctctgactacattgactaagtcagtctccttcgtcttatggcttcatagaaacatgtccctatcctgcagagcctatggatacatgattgctagttttagtctttgactagtatctgtctctccttccagattgtaagttcctttcccaaagtataaaggcattgttctggttttttattgctgcctaacaaatcaccataaaatgtaatggcttaaaaccaccaccaccaccaccataattttgcacatgaatctgcagtttggccaggagttggtggggacagctcatctctgctccatgtgtcttcagctccactggagctggaggatgcactatgagatgactctcccagaaggctggtagggagttttgactatcgtttcatctgcacgtggtggcctctctactggatttcaagagcaagtatcccaagaaaaagaaagtagaggttgcaagtttcctaaggcttgagactagaaattgacacaacatcatttctgccatattctactggtcaccagtcaaaaactcagattcagagagaggagacatagagctcccctttccctcaatggaaggagtgtaaaagaatttgggggccacgttttaaaaatacacaagcatgatttttgtctaggttcctgtctcattctctcctgaacatttggcacaaagtctggaacagaagagataccaagctgaatgaggaaatacacgagcggtgctctttgtaccagagaatctgtggttggccaggatatttttgaactgacccaagctttgtgatttctgaacttttcctacaagccaacttgttacagcaaaccaatacctgggtacctcacttaggaggacgccaatttattcaagtgcactcctcgattcctgactcttttttctgtggttgtgagggaagatggcaaacaagtcactctcacaattagcaaaaatggcaattacagacgcttgcctgaaaacacagtgtactttaaattagttacacatgactaatgcacgtaatacccacccacagttgacattcaacaccacccacagcagagcctgcagccgctaatctaaaaccactggggaaattagccttgcataaagataacctgggaagaatctactcagttatgaatcctgaaagcagcttccttccttcattcattccaacccagctttctcctacactcattggcctgattataaatggaaaacccttattgagcacctactatgcatcaggcaccatattaaatgctttgcaaacgttgactcatttcatcctcacaacaacccatgagcttgtttctttttaaatcatccctctggtggcagatagacacgaagatgaccccatgatgcccacctcctggtattcatgccttcgtgtgatcctctcccctttagtgtgggcagaatctgtgacaaagggaatggggtatgtgtgatcacattgtgcttttcatatgctgaagtctctctctttctgtctttatagttgactttgaagaagttagctgccatgagtcccatacccaaaagaaaatgaaatttgccaacaacctgagtgagctcggaagtgggctctcctcagtcaagcctccagatgagaaccaagccatggctcacaccttgactgcagcctggcaggtgacccaagtaggcaccagactcctggaccacagaaactgtgagatcataaatgtgagttgctctaagccactaagttgtgttactttgtgacgcagcagtagctaaagaacacccattttacagggaggacacgtgggatattaaccatgttgctcagggaatccctgggatttaaattggttcttccaataataataagagctactatttctgagcccttacaacaagccaggcattgtgccaggtgctttacccatgttatttcctttaattctcacaaaaatgttgtgcaataggcactactctcattttactttatagctaagtaaactgaaatcgcaaaggctatttgaccaaacttacagctctttagtgttgaaaccaggatatgaacccaggcagcttgactccagagctcattatttactcttaattctctattcttttgcttcctggaacagtgcaagtaactgcaggtttattctgataaaatgggaaggctcagctctctaaaccaggctaggattctcagagctgaagctaggcaaagaaactgaatggagaggtaaacattgtcttccccagttgcagatcctagaggtaagacagtcatcaatgatgaatccacagcaaacaaaagtctgagccaaatatcctaagcaacatgagggctctgggagggagatttaaagtctgagtgaggcaagaccatgaagacagcaccctcagcaagaatgtggttggagaaagagggggtacaatagtccttttgtaagctcaactgcctccctgcaacctcataggtacagtcttatggtataaatctagagaaattctgcaggtaaactgggcatgtctggggaacctaatctgttagccaggagcaccctgtcaaatatgcatctatgaaacagacatgagaacatagtagtatacactcagaattgctagagtggccttacaccagctctagggtagaacctgccagcatcacatggcctggtcatttcaaaaaccttgcaggaaagctagaagagaaggccaggtggaaatgggatctaggagctgctgtaacttgatttagcttggcctagattctgtccgttctgatgatgtaataggctctgtccccaaagatgagtgacacagcccctgccctcaagaaactcacatttgagtagaacacataaaggtcagcaaaccactagaaaaccagaaagtttatataagctagagcagaggtccacatgaaatgtggtgggagaaactaactccaaatagcagaactgggggaggcttcatgaaggtaggattctgcatgattctagaaaagtggttaagtattaaataggcagaagcaaagagaaaggtggtgtactgaaggatatagaggtaagagataacaacagtattcatagagcaacaagaaataagtttggccacagtgtgagaagccaggtaaactaagtaatgggttacaaagggaaaaaaaggctggggccagattatctaggatttgaaatgcaaaaaaaggggacattagatcattattatatagtatgaggagttctagaatatttgagaaggaaagtatttaaacttgcctgacatttagggaaacatcttgtctccctcatttaatatagtcctgaatgaaaagggcgttgtttcttagaaaattctaaggaacactgatcacatgcaagtttccataagccaaagagtcctcttataaaacacgtatcaaaaatgcgtatattccttgaagatctgcaatgcatgttaagatattagaacagcttggatgtcctgcagtagaaaaacctatttaactctgtttcactcagtgttttcccaactacttaattacaaatttctttctatgaccaagcatatcttactatctcttgaaactgtaggacatgttaccgcatgggatgcatgctcggtgttctccagtttttctaccaaagagcttcttaaggtaatgcccaagttcttactacttcttacaagaaggttgagaggatgatatctgttttgtgtttaatgagtgagtttcgctaaaagggatgaactgaggataactctactaagtgccctgtcatctaagaaaacattgagtcagtcttttctgcttcaaagaccaggaaacttagaggtttcactgttgtcctagctatttgaagctcccaaatggacttgtctcaatacaagtatcagagcattccacattaattacaagtatccattagaaggcccaggagtggcttttcaggcaggtaaatgggaccagaacagatctataaaagcacagggcctgatataaatcagaccaaaactaccaaggggtcttcactgggatcaggagcatgattcagccataaaacgattcatagcttcttcttccatataaacattttgtgtctcatggaaggattctttaccatctattccaggcaacagacccaaagatacagcacagaaagggagcataatttggctataaaaatgttgtaataagtgattttatataactgaaatgccagttcctttactacatcctcccactcattttacaaccagttaatatttttctgaacttttgtgttgtattccactcagccgcctctgcaatcatttttgcctatttttctgccagagccacaagaataaagctgtcagatgatctgtgaagccatttttcttgtctggcaaattgtctagaagcaaccagaacctcctacctgctccactatgtaagagaagaagcctgtcttaacaaaacagaattaaaatagtcttttgacccacgttatctataggcatatagaatgaaataactgaaaatatatttcactgacttttttttttttaccttgctccaataggattgaggtggatattcttgttaagcggccctggtgttgacatgtttagagagatgttatatagccctccaacaggaatatcaagatatttgaactgcaataataaatgtggctgctcctaggggaagaaggatacagcaagaaagtgccccagaagaagaagattaagaaccgaagtgagctaatggtatacagtggttaggatttgaatgtgattaggatttatagtttcaattagtgccggagaacaattttagaaagttattagcaagcaactggcattcgcaaagatggctcatttgtgtgttgctcaagattagctgggtcttttagttgtttacaaacacacatagtggcttgtcttgaatgtgtagaagtgactgcaacattacatactcagagctctttagcagaaatgaagcctagagctttggtttcttactattcctgtgtgggcaaagcaaaactcaattttgcaacattttctttatttcaaaaaagaaggtaagtttccctacctgttctaaactccaacatgctatttcaaatgaatagctttcccattcaacaaactccttcatatttaaaagtcttaagtgcctcaaatactccatgttgtgttgcctagaatacaaactaattttttaaatctccctactggattgttttccactgaaacccataagtctttacattggactgtatatatttttctcttttaaagcctttggggcattattcatacagggcaaaaattctcaaatagattagaatcctggttgaggcatctgcaaacacaacaaaaagcactcagtctcagggagttgaaagctgtgcctggttttgttcatgtcaaaagccatggaaggtattacatcaccttgagccagcagaccttgaccttagcctcccgctgagcaatgagacagtttccccaggcccggaatgtgagaaatacaaaggaacccttcccacacacggtgacattaggattcctcatgggatgacaaggccttgctccagggatgatgtttcccactgtaggagaacagctactgtctttgatgaactgagtctacagggctattgaaggtatggtctttgatctcaaaattcaagtgcttacaaaatatccatttctttattttctctattttgtaacctaactaaagatatttccttatctgaaaaacatacattttaaatacaaatatatattttctgaaatcagattaatgtgtctaaaccttcgtttcttcagctgagaaaaactagtgtgtgaaatggaatccgggaggcttatctgatagaaaacagggccagagactgctcacattgaccagtcctattccactgtggacctttgagcctaagcattcttctattatgctactttgtcaataaatgcactactatgcacccattgccttctgggctcttatcttcttgtttcctaaccctcctatacataaataaatttaatagactcaagtacttacacaggtaagagaagctcagatctcaagaggattttgctttaaggcctgcaaaaatcctaaggcaaagagacagcaaggattcagctctctttgtgagatgaggaagaagataagataactcaatcatgctaatatctctaaaaatttatcctgcctttagtctgttgcaggtataaagagttcagagttctactgttcatttttcccattcctatctagaaaatattcgtctttctctcagttttgattatctttggacttgcttgaggaggcaggaatttgagcatgtgggactagattctagaaccatggagagttaaggacatggttttggtagtggttatgagtatggagctgtgatgtcaactctgcctttaaggattatgacctggacattgaccaatcagataggcacctatgaaatgaatgctgactgatacagaaatgattttgctgtactggtaaatactggcagactattagctcagaaatattatacatgttgggtgatttgattgagctaattggaatagcattctataaccaagccaggaaagatactgaaaaaatatgcctctctccaagtcagagatattaacagcaatataaaataatttgtgttgtatatgcatttgtatgaatattatgtatatactcatacgcaaataaatatatactcatacaaaaacaaataaaaggccagttgcagtggctcatgcctgtaatctgagcactttgggaggctgaggcgggaggactgtttgagcccaggatttcgagaccagtctgggcaacacagtaagacctcatatctacaaataaaaacattagctgggcatggtggcctgtacctgtggtcccagctactggtcccatctgaggtgggaggaatgcttaagcctgggaggttgaagctgcagtgaactatgattgcactgctgcactccagcctgagtgacagagcaagacctcatctcaaaaaaaaccccaaatatatgtatatatgtatacatatgtacacacacacacacacacacacacacacagacacacacctgtatccatccaaagttaaataacaaataatatgttgacacggcaatttcaaatctactcttcagagatgtatcaaccaaacagagagggagctaaggttttgatccaccaactccagtcagctgctaatagaaagctgctctgggaatattaattctctggcacttgcagcctgttccatgaatgtgcaagctgaatgggctcccttgaccagagaaagcccttcggcaaagagacacagtagctcaccattggaagtctttgggtctcctggcatggaaatggggagtgcttaggaaatacgggcaggccaacactgtcatggtctgccgcaggagccagctgctccaggctgtctgcccagattcaagaccaatggatgcaagaagaccctccctttctaataattctaattagtctgaccaaagttctggaatgtaaatcttatagcctctagtaggttccagtgcaatgctgtggttagtcaagcttgggccatgtgacaccagcccaaacctcatgagtaattttttgtgtatctcaaaatagctagaagagaagaactgcaatgtttccaacacaaagaaaagataaatgttcaaggtgatggatatcctaatgaccctgatttgatcattaaatattagatatgtgtatcaaaataaaacacacatccccaaaatacatactaacatgacatatcatttaaaattttaaaacatacataagaagagtagggaaggctgatatctcttagcacttcagatattggtatattaggaacagggtagaatcaatacaaggcagaaaaaataaacccaagaaaatgtgacttgctgatgtcgcaagtactgaaatatagatacagtcttctcattgccatgcagccatgagttgaaatctcttggaacacatgacggtacctgaatctctaaaaggccagttggtggtgatcacagtgttatctagccctctgcctgacacaatttttttttgtcctgggttttggctgtagtggttgggagaccttggaaaaaagaaattcaggtaaaaggagccaaaaattaaaacacagaggcaaatgtcagcctagttattctttcatacaatagaagggtggaggggttgtaggaaataattgactttgtcaatgggcagcttaggatggtcagtatagaagacaatctattttagcttttacaatataaaggctaaagagattacagacttgatctccctaagaaaataaaaatagggagagagacttagaaccaacgagcattgagagatgcttggttatattagttatatcttagacactgtaatattttatcagttctgtgtctgatcaatgacagaagaggctattttgtttcatttaaagttttttataagaatcacataactgtggctgggtgcggtggctcaggtctgtaatcccagcactttgggaggctgaggcgggtggaccacgaggtcaagagatcgagaccatcctggctaacgtggtgaaactccgtctctactaaaaatacaaaaaattagccgggcgtggtggcgggcgcctgtagtcccagctactcgggaggctgaggcaggcctgaactgggaggcggagcttgcagtgagccaagatcgccccactgcactccagcctgggcgacagagcgacactccatctcaaaaaaaaaagaaaaaaaaaaaaagaattacataactgtaaattaagaacaatgcaaattctatgtttgcatacctaagagaaactatattgttatcacatcaagagagaatttcccttcccaacagttttgataaaagtattggccctcagaggctccaaccagaacagatgtcgacttcagaaacaaccacagtggttctgaagtgctcctttgcaggaggaaagctcgaattgccagaccacttagagaaatgttagatgaacttgagtattctcagtcttgctttgatatatgactgcctggttttgtttacatacaagaggtagaagaagaaagaatgccacttgacctaaaaatttttgcatttgttctcattatatgtatcagtgtttgacaaatgatgcttcctgatggaaagagcaccactggtttgagagctcttgtgctgcattctgatacatagaaagaaatgtaactcacatgtggttgctaaatatttttcatatgcaaacacttcttttgagggtactataacatgtgggatctgcaaagaagctccaaaaagctgaaatctactttgtgtactctgaattttaatgtgcagagaacagcaggctgtctacccatacaaattggcttttaaaaccaagcatttaatcttaaggcaaataatctgttattttaataattaattcaactccttgaaaaagatggttagaagccagttaccaagagatttaaaaaatagttattttattgggttcaactttaaatgaaagtttaatgtttagaattagacaagtgaggatataaatgttttaataataggtttagattattttgataataaattcaaaagacaattaatggtaagtttgcagcaactggtgaaataaacaaggtcaagagaggactcagaacagtatatgtagaggacttttggggaaaatgaagaaagaaaaatatggaaagagagatggtcaagatgcagcaattctttcccttggttttgtgtcaaagttcttttctatttttactagagtgtcatgaaacaggcaaaaggatttcagaaaacaaaatttcacagtgaacttttagtgagagaagttttttgttttaaaaaactgtttaaaatagaagaggtaaagaatatcagtaccagtggaaagggactagatagaaattcacaaacactagatttgagatttagcgctaccactgtctagataactttggacaagtcttaaccttactctatcccagtttctttcaaaaatgaaggtgatggacttaatcctaaatatctctttgaatcttaaattaagtgattctatgcaatactttaaaaaaaagttaacgtaaattttacagcctccagtaggttcaagtgcaatgctgtggttgaatcttaaattatgtgattctagctaatacttttttttaacttaatgcattaatgcattagaattccaacagaaatcctaaatcagagatcagtagcaattgtaagcactgacatatattcatatgagaaataaaaccaagttagaaacataattgaacattatctcaagctggtttcacgttcttcaacagcctatatagtgagtgatgttatttaataaaaattaaaaggcaataacaaacatttttgagtcatatttatttcctttaataaatataatgagtgtttgaaggcaagaaaatagtatttcaactctgcttcctttcttccttttttcttccactaaaatctattgaattttcctttggctttttagggaggctaaaacaaacaaaatcagtccaatttatatatagcaagcatctttgtttcataggactccttgcctatgcactgattccttccctgtaggttagcagttcagggaatagtatttatttgttaactccaggtgctaaacgggttcagacacaaagcactttattgaagaacctggattccataaaaataatctctgcatttcttttatataaaaggagatctgggactaaattcaaaatgttttaagtctattttaagtagaatgaagtcattgaagattagaaattgatgtttaggtttctggtttgttcaaataaacagagctgccattcttgagctagaggttagagaaggaccagatctgggaggaaagatgatgacttcatcctgtttgtgtgcattggaggtgccttggagagagtcaagcggaactgtcctaggagacagaacgtatgagtctagagactagtaaagaggttggggctggagacatcagcctgggagccaatggcatgtccttctggtttattaaaacaataatcccatgaaaaagagtgcctgagaataaattactaggagacagacacctcccatgctttacctcagacatgcactgcaacaatttcatgggtgaataaagttaacttcattttacaaatgaagaaactgagtctcagaggcaagcagaccagaggttttcccatggtgaaacatcctatactttttctcaggtaaaaataattaaatgtggctcttccccccccagcctccattctaatcagaataagcagttgctggtggaaattggtcaaggaggagattgtgcctatggtttctcaaagaggacctgtgtgatttctactttagaggatgtatgctatcaaataatgagaaaagatcaaattgaagagaagaaaagccacaagcaatcctttttgcacaatcagctacacagtgggacaagtttgatatttgtattgttatttctcatccttatttgagccttgccagcccaagagtttaattttcttgcaatcctttttctattattatctttctattttcattaagtgtctgtcactggacttctctgtggtcagaattccaatatctcatgtcattgtcaatgctaacttggacttcagcattatcccaccatcatgggtttttccttattgacctgtccagctcttttttttcttgtcatttcaaccttggcactggaagccagtcacggacacacacacatacacatacacagctattcctggaaacacagggctgagattggagtctgctgggactagggagggagaaactatgcaaattagataactgtaaagcaaatactgtaataacttgaagtttgtgctaacacacatttccaagacccggacagtccccatggaaacaggactttgctgttgcagttacatcagaattctcttaggtaagtaatcagtaacagcatacactttctttccgcattgtccttgtcacaatggtgaatcctcaaatgcaaagagagaacaaaaggagagagatgcgactgattcccggatgataggtaaaatgccctctagaaaacaccaacaacactggagagaggcaacagtgggagtttaagcaataagtgtttttttttaacagacaacaatgaataagtacatttatctgcaggctggttagtaatttgctaaagaggctacagttctggttagctcacttctattagtggatatttactgtgccccaaatatcaagactttaagttagagcctggcgaggggcaagtctaaaattctaagttccattgagcttggagcttatacaatggtgatgggtaagggtggagtttttaagacaataatataaaatcttgaatacagaattaagtactgggcattagaagggccccaagaaaaatgaggggctttaaagtgcatgcttcactggtatcttgataaatccacccctgattttagaaacagagtgtaataaataatgataaacataaaaacaacaataacagcagcagtagcagctactctgtgctcagtgcctagccctgtgccaagcacttaacatgcattgttccataaattagacatgaatctcacaacaaccccaggaattacatatcaatttttgcagaggaggaaattcaggctcagtaacttgttaaaagacataaagtggtagaagtggattcaaaataagccttatttttaaaaacaatctagtaaccaccaagatacaaattctccataagttcttgataatattatcacaacattaagggaggtacctgagccagtcttgagaagttctgaaaaatttttctgggtaagataatacttaaagtggcatttctcaaccttagcactattgacatttggaggctggatcattctttgctgtgggagctgtcctatgcattgtagggtgttcagcagcatccccggcctctaccccaactagatgccaatagcatcctctcttcagtttggaataatgaaaaatgtctccagacattccttaatgtccccttgtggaggaggtgcaaaatctcccagttgagaaccaataacttaaagaatgagtaagaagtaactagatgagaaagtggcaaggtttggtggggtggggggaggggcactccagaaagagggtgcagcaaaaacaaagggagagtagcaaaaaacagcatgacaggcatggtgggtacctgtcaggtaatgaaagcaggcaactggatgctacttgaggctacagcccatggcgggggatttgttggtggcaaagtaggaaggtaccagtttacacaggtcattgtgttacatgctaaggagttaaagttttatcctataagaaggaatagcaaatataaaactctctaacacctgatagggacaggatcacaggtacatttttcaactgttactctcattcctttgtggataacgtatctgatgggaacaagtccagttcagttaaatttgcctttttctttactttttttttttttttttttggaaacagggtcttgctgtgctgcccagcctggagtgtggtggtgcgatcatggctcactgaagcctccacttacaactcctggactcaagtgatcctcccacctgagcctcctgagtagctaggactataggcacttggcaccacacctggcaaattttttttatcataggatctcgctacattggccaggctggtctcaaacttctggccccaagtgattttcccacctctgcctcccaaagtgctgagactacagtctggcccttcatgatctctagatattaccaaaagtcccagagaaatgagtgcatggatggcttaatgacaacccactttcttctctggaagaaagaacttagtacagccctaccagaaggtgggatggcaatgccatcttcagacttgagtgttggggaggccttttctgctaaccaacagcaaatgttttacaagagaaacaggacacacagtagatgaaggcagccatggaaaatctgtatgaattatccactctgttgatctgtgcttaaaatatagaagggaaagtgaagaataaaaatgtgtccatgagcatcccacctggcttgcatccagattgaacaatttgaatgctaagagcaggattttgatagtatggcagacattgctcattgctcagccaacccattctcccctttgtccttactaacaacatcctgattttgtgtaggcaacaatgctcccagctaaaattacctactttaccagactcctatgcagttagaggtggcccagtaaccctggcaaataagatgcatgcaggcattactggactgagcttccaaaaacagcttttaaaaggggcaagctcaactgcatgaccctttgggcttttgaacctctttacctggaaatgagacctaaagctaaaaatgaaacaactgtcttgttatcatgaggtgactatcatgaagatgaaaacctccacaccaaataagtggaaagaaaagttggaaagaggtggagagaatgactcaatctttgatgtatcagtgctgcattgcctccctcaaaatgtctcaactgttttatgcagctgagcaaattcgtgatctcaaacagcaactcaagcaactccaggaaagaaaaaaaattgaccactggaggagatacctaagataatcctggtgatactttcggtgctacaagaaaaaaataatcctcgcacccaagaagaaacaatgaaaccttatttttcatgtaaatttctactcctgtttggttcaagcatttgaactgttgcataagatttttttgagtgccgctgagaaaagtattatcaatctagaatgcaccagaaagaaagcagcagaaagattacaaacagcttttctaaacccttgtccagcatttaccagaaagagcagcatgaattaacaaaagcagaaattttagttaaaaaaaaaaagcaactcaactctgattcctgagacatataatacaggacgtctatcgcccatttaccctcatccaactcaaatggctaccaaactctaaaattagcagggcatgtcgggaagacttcttattccttgtattacagatctgttgacgtgtcagtagcattttcctttgcaagttataaaatttcctttccccagtcttcaaataggcacttccccctccccaaagtctcttttgtcaccaactgccataacccaccaatcagggaaacaaatttcagttcataaaagaaaaccatgggtgacctactgaggaccacagtttcatttccataacaaagactgacatacaacccatgcccaaagtctggaacagctatgaataactgtggctgaatagtctattttctgttgggattcatatcaaactctatatttgaacttgagatatcagaacttttgtattataatacataaaacctaggtagtgagtttgaattgtctgcatttattctccatgggtaataaaaactcattgtttctcaatgtttgtgtaactaaactttatcagctggagctaatctttaattcagaagtttgagcagtctgtcaagcaatacctggtgaaaagaaatctggaaggttcttgacaggccctcctgaatatggaaatttaatgaattaatctttctaattcgttggtgagaaacagtaaaccagcatgcatcagtgggcacgtgtgtgggcatgtggtagaagagggtataaggaagtaaaaataattttcttagtatagatgcacaaaatatttttaatataaagaaatattaactaccattcttcaatgggtagcctagggaatccatagattggaggagtagccataagcaaaatgtaataaaaatattggcattgcatcataatggggtgggattgtacaagttaattggatatgaacaaactctcaagaagactctcaagaagaacatgcattttaaatgtctgtagtcttcatttattttttctttttttaaccttcgtgagatatttgcagtgtttacatggagtggaattgtggcatattttccataaaatactcagtttaaaacatttatttttaaaaagattttccatcacttttcttaaagttataaatattccccatccagtactcccttttcactatctcccactggaaatactgcaatttctctagcactagataaatgaccattggttttacagtacaaaaattatattactcttgatttgatcctaagccaggtagaacgttgctttgaattcaaacccttgctaaaacacagagcacacaaaaagtctttattaataaagatttatgatactccatgtatcaatatacctaactcacatggacacaaactataagaaatacctttcataactggaaatctagatataatttgggctgcaggcatagcgtgatcaaggctctggctcattttctttgggtttctcttgccattgcttttgtcgatgaaaaatttgttcttaggtaacttcccttttgtctgcagcacatctatcagtatgaactgggatattgcaaaaaagtgaaacttctccccaaccctaaaagcctttcgctagttgaactggttgggacacatgactctgattaggcttctggaccaatcacaggaaaaagctttcctagacttggctagtcaggatgtactcttggtgctggggatagaactagtttcaggggcatcacatggtgttgtaggaagaagggtggtactgagacttaaatagaggaggaagaaagaaatggctgctagagaaataatcaacaaagtctactgcatcctgcattaatgaaatcctagaaaagagcctgaatgtgaaacagatgagagacaggggcattctgtctcttggtggggcatttctaagactcacatttgtgaatttttattttattttttttaagaggcacaagatcttgctctgttgtccaggctggagtgtagtggaaggctgacagctcactgtagcctcaaacttctgagctcaagtgatcctctcaccttggcctcttaaatagctgggactacaggtgcatgccaccaggtctgactaatttttaaaatttttgtggagatggggtcttaatgtgttgcacaggctggtttcatactcctggggtcaagtgatcctcctgccttggcctcccaaagcactgagattacaggtgtgagccaccatggctgacctgtttgtgaattttaatagatgattggtcaataaaccaaagtaaaagaagaatcatgcaatatttagctctacgagtagccattactgactaggaagaaaacttgaatgtgagtgggacgttgatttcttgtgtcatgtagaactcaagatgttcatattttttcaggaaaccataaattcctatgcctgaggaagtacttgaaacattaggttcagcctttgcctgcaggtaggcaggtaggcagggaggtaaatgtctaaacttgtgatttccaggcctttatagccatcttgccatgctttcatgggatttttcataggttaaattcttaacagcaaaattaatgggtcaaagaatgtttccatttaaacatttgataactattgccaaaatatgctttgaaatgtcatgccaacatacactatccaccacagtattttaaagcacaattttcacatttttgccagcattagatgttatcaaatcttaaattcctactaatctgatagataatttaagtaatgttttaagcatctttaaatacaagcacagttgaatctctttttatattttattaactcttaatttgtaattctttaattattgttagagtgctgatttatcatatgtttatactaattctgctgccatttgcagcagaattagttgcgttttacaatgtcctctgtaagagctaaggaattaagagccatcttagagcagaaccatttttagggtgccaagcagttttgttacctagtttgtaatttatcagttttatttgacctggagatactgaggaggccaagcatgtgccttagattatttgctctaaatataatttatcttagccagcttttcgataggtggagtgattagacaagttgggatgatttttctaagacgagctcattattctctggtgaagtctacatcaatgatcatgggatggcgggactactcatatgttaggtttgacaatttttgagtgtgaaatgcaggaaactttgtttaaaacattggctagaagacctctgcctctccctttgccagatgcaacaagagtagtattgggttagaaagcaatcaagcaatcaggttaacagcataaattaaatagaatcagctaatgggggaagttcctccatttccatttcaatttctcctgtctttgtgctcttccccacacccaaaggtccattcatcctgcgccctccctcactcactgtgtcccaggctcccaacctgtggggaatacctatcacggccaaactctctcctgcctcagggcctttgcatttgctatccccccttctagccttcttccagggctgtccacaaggctggcttttctcttccagtatcattggaaggtcatctcctcagaggtggccccagctttctgttattacaagactctgtttctttctttcctggtccttatcacaattacttaatggtatgatttttttaatgtaaagtggaatcttttttaaaaataattattttgcttgtttacttatgtactttataaaaaataggctccatgagaagtaggatcttgattgtctagtttgcattaaatttgtaaaatgtttctgttttgtgcttgagcagtggaaacatttcgaggcctctgtgggaatcaaatgatggaaatacacttccctaggcttcagtaggatggattacaaagtcaaggcttctttccatgatgctgttgaacagagagtatttacaataattcacaactccccatcccccactaaaaaaacctgcaattataagcactattgagactatgtttcaagttgaaagtatacttgccatcaatttagcttgtgttgcagtaacacttttaaccagagatataattatgctcatggtatgaaaagttacatcagtttacactgacacttgattgctcagttcatcattaccaaatgtctataaaaatgaactagaagctggaagcatatctttgactcactctcttgcttaattacatttatgaagagaagcaattggtcacatatattatccagggtttcgaagtttgcatttaacaatatttgtcacaagaatagcactggcaaaaggaaaggcaaaaccaatactatgctttcattaaatatgtgtatatataaaaatataggtgtatacttaaacataaagacattttatgtgtacttttgatgtttttatatataagtatacattttattcagtttatttttatttgcatacacgtatatatttatacaaaaaatatgtaatatctatgttatgtatattatttacacaaaatgcattatttttaaacatacaaagaacaatttgcctgatctattaaatgcaaaatgtccaaagcagcaactgtttgggtataacctagacgtcatttttcataaattacacagtcactgcattacaaatattccttttgatttgttatctcctatgtagttgtcatgcctaaattaaatagacattttcaactcataagaaagggaaatctgagtcctttaaggaacaattctaagttgcatcttaatctttcccatattctctctctacttgcgtatctgagttttttttttttttttttttttttaagacacagtctcgctctgttgcccaggatgaagtgcagtggcgtgatctctgctcattgcaacctctgccttccaggttcaagcaattctcctgccttggcctcccgagtagctgggactacaggtatgcaccaccatgcctggctaatttttgtatttttagtagagacggggttttgccttgttggtcaggctggtctcaaacttctgccctcgggtgatcctcccgcttcagcctcccaaagtgctgtgattacagacgtgagccaccatgcccagcctctgatttcttcttaatgtcctcagatatttttacactttataatgtaaagtataaaaatacctcttttctgaggttgggaaggtatttgctatttagaaaaagtcaggaaacatcctctcctgaaaagtattcttactgtctgataattattcaatcatgactcggttgctttatgcctgcagtatgagaggtacatataacagaacattgtggtctctatcatagcctattactatggctgatgaatgccagagcgggagacaagagaggaaaggggtcattgtttaacacatttcttcccagagctagtctctggcattcaactttctaaaagttgggcttcaagaccattgcatacatcattaataaccagacacagcctacagaccttaccccaaacggcctctattagaatgggattcaatatatgccctaatctgtgttacagtacaggaagtctgtggagattgacagggagcatatttaataatttctttgctgtaaatcctggaagcatggtgttagggtaacaaaataggaaaaagaagagactcttttgaaaaccagccccaggatacgcaaccttagtcagcacctgaatttgatcaactccactgacaagggctggtgatgttgcccattaccatcagttattcaggtttacccaggcaaggagaaccggatcgacaaccttttcattgcctgacccccaaaccgtatcctctgcctctaagtcttttgggtgaaaaggcctgggggcctaagaaaagtttccagggaatctcatgtttctcaaagtgactatttcaatgttgataaaaattgggcagcaatatggtccactctaatctcaggggagccaaggtgagagggaagtccctgtcagacaacagagaaactgtctcttgccccttgccaaatacaaaagacactttcccaaaggttcaacaccactcttcaaaattctcacttttttcaaatctgctttattcatttgcacttaggatcaaagcatgtcctcatttgcacagtactaggtacttgttggaataatatccagttgtgacataacagccatgacatgaaccagaaatcaaactagaaatcccacaggactacagagaactgaaaaatgtttcctctccccgataccccactctacagccattctaacatgtggtgttttgatacattctgatgggatgtgctgagtctcattcatattaatttggccctcaatatgaatacaagtatgagtgaaatatgtaagtatattgaacgagaggaataagccagatatcccccaacgttgccttcaatccatgtggtgcttttcctgcagccggcactgtagtcaagaaatccttttgtttgtttactgaaacataaatctgccagaagagcctaactgtaaattactgttgcatttctgatggaaagctgccacataatttaaattccaacagctctacaggttctcatatttcttatttgtaacttgccacctcacagacaaagtgcattgtactatcattttaataaatagtctttgagcaaaagctgtttttgtgtccaaattccatcttttttttttctctttctctctctctttactgacacatcctgagattcaataaaggcctttgaaaagtcatttcatttcaaaggtagccattacatttcaacagccaataaaccaaatgaccaaatagaacgatgtcttcaaaccaccagaggaggtgagtgagtgacaattctggtttgtcatttcctctgaagagaaaggatgtcgttgatttctcttgttcagccacttagttgtgagtaaacattattttttagaaaatcagttttctcgggttttctcatcaacgaagtatcttacccataacagtagataattacctagcacatttgtgaaagtggagtctatcttcacgatagagacggtacttagatatggattaagcccaattggattcaccgtccgagctatcaagaaatggatatcatgagacttttaatcttgtataaaacaaaaagattaaactgtcaatattatgatgagctgccgtgacgagtcctgtgatactcactctcagagctgcttctaatgatatgtatgcaaggcatagatttttcctgataatgcatgtaattagagtacagaacaaaatgttctgttcaaattcatgacatgcccgactaataaaggaagagagaataaggcccttactatttatttgcatgaaaaagcttcaatacaggatatactttagagaaattaatttttaatctaggtgactagacgagattttgaccctgaactgttttctgagttgacttgtgagaatttatgcagaaataagactgtgatgcttacaaaccagacaggcattgcttttttcccattaattcctgaacgtcttatatagtcaagagaaggagaaaattggtccttttaaaagctcaccttataagaatttccttctatgaaacgtaatcagcaaaagctgataggaatcttagcgggaatgtattctttttaaatgtagacatttgagaagttagatacattgattcagcggtgatgattctccactgacccatataaaacagaaatctttagttgtatattgttatgaatatatttgggaggcctcttgctatcattgtaccagctcttcagggtgaattatggaccctaccatcagcacttgaaagaaagctttatatcaactcttgtgtttatttttccatgataaaggttagtatcacatctactggatagatgcatgaaattacttttaagaggttttttgccccctcatttttaaaaacaatggctgatatcaacagtatccaggtaatggatcatgtaacagcagtaatctacacttacaatgcagtagaaagtggctaagcatgagataaaaggcaaaggcctcatatacgtttcagtaccacttgacacactagtaagtaagagcagctgtcatattcctcatgtagatatgaaatataaaagcagtctggcccatgttagtaaaaggcaccaagatccacttggatgcccaagccagaaagagaggtcatcattgcttcctccctttatcttttcttccacttccaagccatcaacaacttctatcaattttctcttcccacttatatcacagatttgtcccttctttttggccttagcccggctcagactatcatttctgattgcctagtcttctaaaagttggttttgttgttgttgttatctctcctccttggcctcctctaatccatcttccacaaagcacacaaataatcagattatattgatctagcttaaaaccttcaatggcttccccttgcatttagagtaaatccaaatgcactaagctcagatccttacgatttagcctcttcttctgtgtctcacatcatttcccatggagccaacaacaccatagccatcatcttcagccatcctcattttctttcctacttccaggcatactatttcctctgcctgggtcattcctcaccctgcctcttcctcatatctcagctaaaatagcctctcttcttggttgtagtatctagagtaatcttgccctacttaggaattgcctttgttgtgcttatcaaaatctgtaattattttgggagtaaacctctttatttgtccatcctcctatgacaattaaggtagacacactgtgtgtcttggttgctatcacatcaacatatctacaagtcctccatcaaaattggctgaatgaatacatgaacaaattacaatagcactttcatagggagaggctgctaaaatgtagagatgaagataaattccagaggaaggaaactgcctgtccttgatttgcttttatgtcctggaatcatagatttcccctaccaaaatattaaatgtgcaattatatatacttttcacaaagagaaaggggggaggaatgaatactctcatatattgcaatcataaagcttgcttaaagtatctattttggctgggcgtggtggctcacacttgtaatctcagcactttaggaggctgaggcaggtggatcaccggaggtcaggagttcgagaccagcctggccaacgtggcaaaaccctgtctctactaaaagtacaaaaattagccgggtgtggtggcaggtatctttagtcccaggtactcgggaggctgaggcaagagaatcgcttgaacccgggaggtggaggttgcagtgagctgagatcgtgccactgcactccagcctgggcaacaagagctagactccatctcaaaaaaaaaaaagtgtctattttatttgtgagtgagtgagccagatcttttttctggaagtgagctataccctcctggaagctgtgctatctcttttgggccacttaagtaacaaagatactaaagttgttaacgaatccccaagtgctgcatttattgccaaagcacatgtactctggttatttccacttgtgtctattcactgtacagaacaagtgtagcaggcttgtaaagaagtaaaaaagttcttggctgacattattaaatcctttgtaaatcaaggtacaaaaagagagctgaagaaactatgttataacaatatgtaagaaaaataaaagatgtcatggacacatgtatgttttgagcggacaaaatatttaacaatgttgttgtattttaagtactgttttcttcttattatttattgcccaaagaaaattcaaaaagcaggtaaaaaatagttaatgaacaaactacaattgtacttactgaactgatgtaattgtcaaaggtataaattttatcccatataatttaaaatgttaaaatgtagcaaatataaacatattaaggagtataacaagtagtatgtacatttttagaaaaaatggtaaaaataatatgaaaagttgattttgaagacatatatctaactccaatcattatgagtacattgttctctgcaattagggataatttaaaggcaattttcataaacatgcctaaaatgtgagtataatattcattttcatataccagggacaggcactgtcaaatgtaattcatccagtcaaataaattagtctatccatttaaggttaggcactagggagattctgacctcattgggcagaagggctcatccctcaagaaaacattgcctatcccacattgaagggattctgaccaactcagatgtaaaatagtctggaaagtcaggcacagaggcattgcctctatggcttacccactcgtgtaagtccctagctgagtggacacggttatacaggaacacacgtgaggtccatgaatttgtgggtccatatgcatacctgcatgtgcacacagttttctatagctaatgtgctgggggtaatacagtaatactacaaaactcaaggctcttatagcaaacgggggaggtgggaatcagcaagtttacgtttttaaaatcagaaagatctttactaattgtccctccaaaggaaagcgataaaaagtcagcctatgtctttagctcaggcaaacaaacaaacaaacaaacaaacaaaaaacactatagacacaaagatctggtgaagagagacagaaagctacaggaccatgcaatcagagaaagccttctgcaagggagtcacagaagtaccatcttttaaatattaggggggaaaatccttttacttaaagggcaaatctccacttgattctagagtccttccagggaagtagcaagattcgtgttattaggaattggctctcctaacacctctcagggtggaacaagcatgatagacatttaaaggagattagaactcctggccaaacgctttcagcagctgctaagagaggaaaagcaaaatactaccgtcttattgtaatcacatatgcacacatacatgcacacagacacatgtgcacacatacccatgcagacatgcaaacacatgcccactgtcttagttaattcaggctattacaatagaataccacagactgagtgacttataagcaacagaaacttatttctcatagttctggaggctagcaagtccaagatccagtgaccagcagattgagtgtctggtgagggcttgctccctagatggtagtcttttcactgtaacttcagatggcaggagaggaaagagagatatctctggagtcccttttgtaacgatagtaatgccattcatgattatactgaattcatcctcaaatctcaatccacttcactggcgcctgtgggaatctgaattgagtagatcctaagacagtaattcaagtgcgtgtgattgactgaggggatgtttttgataaagggagccagggagcggggcagaataggaccaagcaagaatgtgggctcagctggaacctccattcagctggatctcaagaaaagctctgaagcataaattgcagcacagagttgtcccactttgaagcaaaggggttggccttttgatccctgtgtttggcattggttgtgggcaactcccaggtctgggaataaccttctagttaagaaaaaccttctttgctgagaattctctagtgaacaagataaatgtcagctactagcagcaaaactcataacagctgggagataagtgagctttcctagtaaagtagatcttggcatcaaatacatccaccatagatattctagttatagggagtcatttggactacatagaccatcccctatatgcaaaattcgctcatggtctcgatgtttcacagaggcagcatttttaatctaactgttctaaaaagacagtctggatgcattacacagtacgaactcggccataataatgccctataatgtacatctcttaatttacacacaacctttatgatccaaccctattaaatctagcaagtacttactgatcacttactatctgcaaatcatgataagatatatcacttgatttttcaagcatcctgcaggcataagcagactaggtgttcttagcttctcacaaaacaaattagaggacacaaagtagaccaaattcaactcctttaaatagagttgaaagccacaaaggggttaatttactttcccaaagtcacaaaggtgaaatatggataaatgagaaccttaaaactgtcttttggatgctttttctgtttttgaataagtattcaaactaaagtattcataagcaggcatttataaataataaatatgacatggtcccagaaggataaaaaagaaatttatccagcaatcaaataattatagtctcaggaagttataaagatagtgcagagagctctccccacccagtttacataattataataacaagataagaaaattgacactggtaaaaggtgtgtgtacagttctatgccgttttatctcgtgtggatttgtgaaaccactgccaaatagacctccctgtgccagttccttatagtcacacttagtcacagctctcaccacccctgacacctggaaaacaataatctgttctctatctttacaattttgtcattttctgaatcttacataaatggaatcatacaatacatgacctatcaagaagggcctttatcacccagcatgacatccttgagttttatccaaggtgttgcatttatcaatacttcacacctttttattgctgggtggtattccatgatatggatgtacagcactttgttcaaccattcacctacggggggacattttatttgtttcatcgattttatctattgtttttaatttcattaatttctggcttatagttaatatttcctttcttccgcttgctttgagtttaacttgcccgtatttttctagttccctgggatgggagaatactgatttgaggcacttcatcttttctaattccatggattgatcagaagtatgttgtatagtttccaagagcttgaagatttttctacttttctaatattaatctctagtctgagaacacatttctatgatttcaattattttaaatttgttgaggcttgttttatggcccagattatgggtctatgttctgtgagtgcttgaacagattgtgtagtctgctgtaattgggtggaacattctatatgtattgataagatcctgttggttgatggcattgatgatacatccttgatgattttctgtacaatcgttttatcaattgttgcgagagtggtgttgacatctgcaactataattgtgggtttgtctatttttctctcagttctgtcagtttttgtttcacctgttttgtgattgtattgtttgatgcatgcacatttaatatcctcatgtcttcttggtgaactgacatttttaacataaatgtctctctttgtccttggtaattgtctttggttcaaagtctaatttatctgatattaatataattacttctggtttatttttcttgtctttcttttttttttactttaaaataacatctttattggtatgtaattcatatgcataaatttcaccctgtcaacatctacaattaagtggttttcagtataatcagggatttgtacaaccatcaccactatctaattttaggacaatttaatcatcaaaaagaaacaccacaaccattcagtcactcttcctctctccatctagtccctggcaattactaacctacatttttctctatgaatttgtgtattctaggcatttcatggaattacataacacatggacttttgtgacctttttcacctagcataatgtgttcaagattctccatgttgaagcatgcatcaatatttcattcctttttgtggccgaataacattttattctgtgtatataccacattttacttattcattcatcacttctcagatatttgggttgtttgcaccttttggttattttggataatgctacaataaaagttaatgtgaaagtttttgtgtacgcacatatgttcagatttctttagggtgtatacctagaataggggaactgttggatcatatggtaaccctgtgtttatcattttgaggatatgccaaactgttttccaaagtggtttcaccattttacaattccatcaacaatgtatgaaggttctcattttctgcatcctcaccaacactagttattgtctttttgacttagctatcttagtgggtattaaatggaacttattgtagatttgatttgcactttttgaatgactaacaacattgaatatctttttttggtgtttactggccaatggcatatcctctttgaataaatgtttactcatatcttttgcatatttttaaattgggttatttgttgagtggtaagagccctttacacattctgtataaaatcccttaccacagacatgatttgcaaatattttttcccattctgtggattgtgttttcactttcctgctggtgtcatttgaaacatgaaagttttaaattttgaccacgtccaatttacctttttgttcttttgttgcttttatgtttgctttgttgtcatatttaggaaatcattgcctaattcaaggtcacaaagattcactcctatgctgtcttctaagagttttatattttagttcttaaatttagggccacaatccattctgagttaattttctgtatggtattgttgatgtttgcctggaaatttccattcatccttttactttcaaactatttatataataatttcagtgagtttcttatagatggaatatagatgggtcatctggcaatttttgtcttaattgctctacttagaccatttatatttaatgtaattattgacatattagaacataagtctaccattttatgttttgtttctgttttttttaatcttttttatttctctgctttctttttcctctatttctaggggttacttgaacatcttttagaatttattttgatttatctgtaatgttttttgagcatatttctttatatgtatagctcttttagtgatttctctaggtattgcattatatatacatataacttatcacagtctactggtatcctcatttcaccagtttgaatcaagtatagaaatcttaccttcctttacatctcattacacttttccatttaggaaataattgccttaaatatatctatcctctacatacattgagatccccattagatattattacaatttttggttcatttgtcaaaacacatttggaaaatgcaagaagagagggaaagtctactatgttttgttctttccattgctccctcttcctttctgatggtccaagattttttcttttatcctttttttttttttcagagaactttcttcagccatagattaggtctactgacaaaacttctctttattttcaattttctaagaatattttcatttcttattaatttttgaaggatattttcattggataaaagattctgggtggacatttttttgcagcacttcaaaaaaatgttgtgacacttccttctggcgtccatgatttctgatgagacagctgctgtcaactaaattttttatcctataattaatgcatcatttctttctgactgctttcaagactttctttgtcttttgctttcagaagtttgactatcatgtgctttggcaacaatttttttgcatttattctgcttgggacttgttcagcttcttgaacctataggtgtataccttttggcaaatttgaaatattttcagctgtcatttctttgaatactttcctgtcatcctctttcacccctcatcttggactccaaggccatgaatgttagatttaaaaaaaatagttcccctgtctctgaatataactcctatttgtataactctatcataggtatgtgtacatatccataatatgcatatgcatatgtatatgtacattatcatgtatatatttaatacatgtaattggaaaataaacatatataacttactaatttaacatatatgtataatacattaataaaaatatatgatacaaataatatatgtaatctgatagagagagagtgagagagagagagtttattttctcctttgtttaaagttggaatttctattactctatattcaggttcactgattcttttttctgtcctctccattctactgttaagtgaattcatttaattttcttatttctgttctaaagtttccatttgatacttctttgtatctttttatctttgaagagacttttcatttttcatgtttcaagtttattctgaatgaaacatttttatgattgctgcttaaaatatttgtcagataattttcacatctttgtcaacttggtgttggtgtctatttattgtcttttctcattgaagttgggatcttcctggttcttcttgtgatggataattattttttattaaaacctgaacatcttgtactcaggaggctgaggcaggagaatcacttgaacccacgaggtggaggttgcagtgaaccgagttcataccactgcactccagcctggcaacagagcgagtctccatctcaaaaataaataaataaataaacaaaacaaaacaaaacaaaacaacctgaacgttttgaatattatgttgtgagatctggaccttctttatctttggttttagcaggcttcctatgacactgctgtgtcaggaaagtggatgctccctaccaagtagggggtagaaattcagattcttgactattcttctgttgtaagttggtggtgaagggctcctcaccaccccagtggcaaaaaagagaggcatctctttatcaccaggtcaggacagggataccattttatctgtggtgtgtggctgaagcagagaagttattgtctaaagggttttttctttttttgttttgcatggcttcccctttcctagtcctttggctggaaagagtgggcttttgttagggcatgttttgtttcaaccattggcatttctggattgctgactccaggcaaaaagaaaacttggaggaactcaccaccatgtcatttttggttccaaggtccctcgctatctgggtttccttctttttttctcaccttttagagtcttcttatgttggtttaactatactatccagggtttttagctgtccttactgagagaaataggaaaaagtacatctatttaatctttctaaaagcagaagctctcatccagcaaacttttagaaaccctgttgttcaagtctgcgttggtcgatttgagtgtgattgatgattcttctatggtctcactggagtgtccactgcccttgctctcagttcctcttcctgccagtggttaaagttattttaccggtacgatgccttgtaataagaaatgttaacctgctgtgtggagagctgaacccagcttttgcctagagatttctgccaaaattagaagctaattacagactttaagaattcctttttgttgttgttattgttgttctcaaactcctacaagcttttgctttacttctcagtttagtcttgagtattttatggctggtcagttattttgtaattcttagagtggcaaaactatgctaatctttcacaaaatctacatggctaatattaccatattcaatgatattaaatataagccatatataacacccaagaagaagcaccacaagtctatgattggttaggcagtgtatcagtagattccgacataaaacagagagcatattcaaattaggatatttagaggagggtttattttacagaaacaacttaccaaaaaaaaaaaataataataaaaagagacagaaaactatttataaaagtgatactgtaaggataagggagaatgtatatacaccaccaaaaaggagagagtcacaccgaaaagtcagttttgagatcagtttagagaaaatgcaggccaaggcagtgtcagagggataaaaaaatatacatctggacctctcttttgtttctccctccagtctcctccaggggctcccaatggttgaactcaaaaggaagccataggatgaggaagcccatgttagcctcttgggacagaaagtcagcttaaaagggggcctgtggaatatattcagcctagatggtttatttgttaatattcaagtgtaaatctgagcagattagttaggtggtgtgctgagggacagttagagtcaagaatttaaactttgaatcttataaaatactcagaccaatattaggaatttgagtaagtggaaagctataacttgcttaaaaattaatgcatgtgaaataccgatgatggcttttagctagagtccctataaccaaaatatggggtaacctgggctcagggtttctagtttttccttgatgaatttacttgggaagttaatcatgagtgttaggcagaaattactgaataacttttcaaatcttccagtttctcctgtctatcttctgccatgatttctggcacttaatacctatcccatgttcagggaattacaagaaaaggctgaaaaagtagtaagaaggtagtacatgactgtttttctttcctacactctcacaaatttcagcttagtaattgagtgatacaatctccagtattagcaccgaaatattatttttattcccctaatataatgcataattagaagatccttttcataggagatgctttcatttttagcatctttgagcttaaagaagtatggaaccaactttggaagcagtctggctatagctttagtatgcaaatggtatttcatctgcaattaccacaagccttgagatacaggaaatatctcaaacctggtgatccatgactgatattaatgccaataccttcccatggaatcctataaaggtgaatgcagagcaaataggaaatggaaaaagaagatggattggtgattgcaaacaaaggcaattgactatagaccctctgtcttcttagaggatgcaccaaagccaacatacttcatgagataatgtgttctggagtggaaagtgaggaggacaatgggaagaaattatagcccaggggactgcttttaaagcaaatgaaacctctagaaatccagaggtagaagaaggtcattcaatcccacctgttaccactttgacaattgcgagagcagagaaaaggaacaagcttttgaaaaagttgtgaacaatctattgaaaaaatggggtcatgtcctgtgctgcatgaagacgtttcagtcagtgacaggccacacatatgagaatgatctcataaaattataatactgtgtttttaccataccttttctatggctagatatattcatatatacaaatacttaccattgtgttacaattgcctacggtatttagtacagccacatgctgtacaggtttgtagcctacgagtaatagcctacaccatctagcctaagtgtgtagtaagctataccatctggtttgtgtaactttatgcaatgatgttggcacgatgacaaagtcacctaacgatgcatatctccgactgtatacccattgttaagtgttgcttgtctgtactcaaaagtacacatgcttctcgaattacagtgaagttacatcccaatgaacccatcataaaatatcataagttgaaaaagcatttaatactcctaacctaccaaacatcatagcttagcctagcctaccttaaacattctcagaacacttacattagcctacagttggacaaaaccatctggcaacacagtacaatgtacagtattggttgtttatacttgtgatcacctgaggctctctgctgctgcccagcattataaagagagtattttactactttctactgaacgtgtattgccttagcaccatcatagagccgaaaaatcttaagttggaccatggtaagtctggactatctgtactgatttcgagacaattttctacgttgttgaggaggacatagaaactattaacatcttttagtagatatgaaaccatacattgtcatatcaaattagctatgcttataattacctcaggttaaattattccatttccagtgctagattttctcattatagaattgttacaagtaagaaaagacagatggtacttcactcttattttcacttattctagtttttggtattgtttaacttgcttctttaccggtggatagagtacactactgtatatttttatattgaaaatgtatacatattttaaatgagacatggcagtaaaacttttgaaggttttatggtttcccatgagtttgtggttcctttaacaactagtggcagaagacttgggggaagggaggaagtgtcaaacaaattgttctggccctttccctaacatcgaatgtgaaaaagagagtcaataaggagttttgatgttaggagttcttttttcttttcatcttccctccccattttcagtgagtacgttaaggatgattaaattaaaatttaaaaaatactgactcacaagtacctgttaccgaccttacccaaaatgtcatagaagtacttatcaaaaagagaaaacctacgcacttaaccaaatgggaatttatgttaaataactaacaccgaatgatttgggtttagactttgcagcttgaaggagtccttgaactgctgtactcacaatgtgataaataaatatttacttaaaaatatttctactcaagtagaaaatatcagtctcagggatgataaaaataatttttaatatagcaggttatgtttggcaagctaatggaaacagtacttatttgaaacaattaacatatcaaaaatcattgcccttcactatgtgaaactgatctacaaattcaatgttaatagaggtaggtgatcccagtcaggaattcccaaccagtgtgccctgaatggattaaaagtacccagggatccagctactctagaagctgaggcaggaggatcatttgaggtcacgagcttgagagcagcctgggcaacatagactctatctctcaaaaaattaaaaaaataaagtatgcagggatattattccttacatacttcagagctgcctattgggaggccccagaccaagctgactctgctatcttctacatgtattttatgtatgttttgatatgaaaatatctggaaagcatggccctagttatagactattacatttaaaaagatacatgaactgctatgtatgggaagtttgaccaggaccatttgtaaaagttctctttgtaataacatttttcatttgaagagaaaaatacatctacccctcaaaatttgctctcaagtttgaaaagacagagtctatcttcagcttaagggtgagacttcctatttgggagaacgaaatgagggttgagaaatgatgccttaatatgaccaggaaaatcagagcgtctttaatttggtgatgatctaattttatgtagagtaagtctaccgcctgaagggaggctggttggaaaaaatatacctgtgttacaagatctcattatgcgatatacttcttcacttggaaaatatcacctatgacaagccaccatccaaggggaggagcccaaagacagcaggaaactcagccctggatgaaagatgtttgacattgatagtatttgacatcagtagttgtgatatgttttctcattctaagcaatggcaaaataaaggaaaataaaatagaccttacaaatatatcaagtcaaaagaggcctgagatctaaatctttcttcagaaaattgggatttggttggtgaggaaatcgtaattcctaacagtgtttactggattgagcaaagagctcaaattggttccttctcatgagggtgttcaaagtctgtgcaatgtttctgaaagacagtacattatattgttctattcagctagtctccattgcaaccttgtttgctccacagtgtaatcgttccctgacttcctttccatttaatgtcttcagcacctgctctacatagctttttagtaactgcatactgagtagttctcataggaacaggagctgaaatgactgatgaattcatagaaacagaaacatgttttctcccagtgcaacttgtcttccggcaaagtttcatgtccatgaaaaaataatttgccattaagaaagcaacactattcattttaattaatgcattttctacaagtaatcatcaaaaagaccagatgagtcagtgtttacaaattcacatttttagtaggtgtgtttgactgctccatagatcttgtcttctgcctaaatgttcctttaaaatattttgatttattatgattaaatgtaagctaggttggaccattaattaattacaaataaatttgagttaaacccagacattaataacagcattagaaaaaaatgcactgggtttacatgctaaacagagagctgtaacttggttgtgaaattttaccttctttgaaaatgactgataccaggagttaaaacaggcaccccctgggttaaatttagcccatagggtgttttctttggacagtatcatattttaaaacaaattagaattagtgaccaccacttgaaaatcaggagagttttacacaaaatcaaggatgtccttgatttcagttttaaaaaaaatcacctcttggcatggctgagcctgcaatcttcagggactatctccagttgcccctttaagcaagtgagcagtctagtgtggcaagtttcccacccagtgcaattcactcattcatccaaacagtcattcaagaaatatttcctgagtacctaccatgtgccagaagacattgtgctagattctgccatcatcaaacttacagcttaaggggaaatggacagtaagctattctacaaaattgcacatttagaggagtgctatgaagtaaaagctgctatggaagcatttgacaggatatcctgagctattctgggagtgggagagaaagggtcaggggtttccctgcagaagcacatgtcagacctgggatgtgaaggactaggagaggttacttaggcacagtgtgtcctaaggagagcgaagagtaggagagttgaagtgaccatagattgttcaaggacctcaaggaagttcagtatgcacagacaaagaacaagggggtggctggcatgaatgtagcagggagtaggcacaagcagggtcagacctggagtcctagggttcagggaaaaatgattggtcttggtatttaagagcagtgggtagacattgaggaatttttcagcaagtatcagaaaaagtactttttgcttccaaagtaacattctggtttaccgggtggggaaaaggctcataggaagcaagaatagaagcagtcaaggatgatatgaactagagttgaccctatagaaaatggctcaaaaaattgaaatgaagctaaaaaactttaaagatactggaaattgtacaaggtcataaaagaagaccttccatttgctgccccaaatctactcacccctgctctgtgcacaggaggctggcccacatggactgtttccacaggttcccttacctgctgctctctggtatgttcagccaatgggcagcaccaacaggagatcagagggcggcaggagtgaggtcagggcatttattgagtcagctccctctttgatggatggctacatcactagtggttacattccttttccaaagatcacagctcttgtcagactacagctgtctccagtttctgtaccctttcctggtccttgcccttcaagctttgagacagcagtggtttctcactgttacccacacagggtttcatcattcgtcatcagtttcccttaactttgcccatacatttttaaatagtaccttcactaaattatacttggttacccccatttgagtgtgccacttgtttcctgccaggatccttggccttaccccgaactggaaacaagtcaatttcagtatttaaaaaaaaatccttaccctagtatctttaaaggtaaagaggcaaaaaccaatgataataaaaatcacactgacaaatccaaaagagaagcattagaggcttcattctcctcaccacctctcttagaatgtgatcaagaaagcatcaagaatgaaaaagcacatgggagagacacaggaagggatactgcagttgatgttgttttgtagtggattccccccatcagctcagttgctgggagtgtgcgtggctggagtctcagctgaggggctctgtaggccatgcctttagtcacagagagtcagcatgcaaagactggtggatgagggtgtacaaaggtccatgtaggtcaaccctgatgattatccaaggtccaggctgaggatctgtctaccattgctggtgcaatatctaccatcggccagtcctgcttccctcgaccctcacagatgttgatcccaaggacactctccaataaactttctacatagaagcatctacttcagaatccccttcctaaggaacctgatggaaggccggtattacgatctattttcttatattaaaaacataaaacctcaaatgtcagaaatgcaaatggagatatgatatataatagagtgaagttttttgtttgtttgttgttgttgttgttttttgagatggaatctcactctgtcacccaggctggtgtgcagcggcgccatctcagctcactacaacctccgcctctctggttcaagtgattctcctgcctcagcctcccaactagctgggactacaggcatgtgccaccacgcctcgctaattttttgtatttttagtagagatggggtttcaccatgttagccaggatggtctcaatctcctgacctcgtacagtgagctttataaaagtccatgcaatattgatttcttaatacggatttctatattaataactagatgtagccaatttgtctttttatgtataaatgacacaaaattctctgtgttaaaagtacagtattcttgtggttttagaaagtaacactattttaaagatgattaagaagaatgaccttttgagaaatatttcacatgaagatgtctctatcacaggaggctgttaaaagggacagacaagggttgtggtatgatgtacattcccctaggatattcgtaaatttagctactgtttactcagtccttgctatatgccagaccatgtggtaaatgctctatgtgtatcttctcatgtaatctacaaaataacctttgagggagataattttatcattcccacaagtagaatagaagagcatcctgccaaaagtaggacaatgtgggttcaagtcactgaatcttcataggcattaatttcttagctgatacgggcatgagagctaatctacagatgtgtggcaggaactaaatgagatgcaaggggttgtggaagtgcttttcaagctaagttattatgcaagtgttaggaatgataatcaatgtagtttatgtgtgtgtgaatgagcaagtgatcaggtgcgtgtgtgtttgagagaaagggtcctcaacagactagcaaattggcaccttcatttcattattgtatccatcaataatcatgatatgtgaactagattttctatttcagatgattcaattgccacaaacgaaaggattatatgccaataggaagagaaaagtgaaataatgggatcagaaaaatgacaacgttgaaattagctgggtgtggtggcatgcgcctgtagtcccagctacttgggaggctgaagtgggaggattgcttgaacccaggaaatctaggctgcagtgagctgagattgtgccattgcactccagcttgggctacagagtgagaccctctctaaaaaaaaaaaaaaaaggaaaaatgacaaagtggaaaggcattttataatacaaaacatgatttctactgtccccttttcctttttcaaatagtattggtaattatcattgttattattcaaggtagaaagtgatcatttctgcattctttggagtaaactggttcttctgctgcttgacagtcaaaaatatgtttgctcaacaatactccactcatactcttaaaaaattatctgataagaagtctttcaagtctcaccagttcactttaaaatgacaaaacaccagtcatgaagtcgaatggagtttctcagattcatgtcatcatgattggtgggattcatgtcagtgttttgtaagaactacaataagtttcacttctatcatttggagtgctggttcactgggaaacatttataactaatgctgttgttcataaacagactatggaagaagaatgcagctccaaatgggaaatatgctgaaagcctacctgcataaatttgacttaatattactaatttgggtggatagatcattgttcacaggcttgggtgagcaaaaccagtgtcttggagcttgaattatagagagaggaacactggcttattagacaggcttcgaatgcaaatgggacacagaaatttccataggctctgttctgataatttttaaaaagacatttttgagagccttggagaaggtattgcatggagtagtaatctaattgtaaagttttcacttcatctaatagcaacgataataaaatctcaagaacaatctttcaggaagcttcaggagtgtttaaaagatttggcataattatcaccacagttttgtctttaggcatagaaaaaaaaaggaagaatcttcaggtgatcttggaatggcctaaacatcattcattcatttatttattcaaagtacagtcttagagcaatcactatattccagattctgtgcaaagactgaatataaacaaaacataaaacattttttttaagttctcatagtgcttacagacctgtgaatcatgatattaggagaaatgggctctttctcttttttggacaaaaggtaattcttcactcttgactgtatgttgtttatgacagttacaattggagaatggaaaggaaattaggaatgatgggtgtaaggggagaagagatagaagaaaataataaaacaagaaggaaatcaaaggcaatgttatcatagttgcttcagggaaactatgccttgatccagaattgaggtacagctgccctagaagtgatcagctcaataactcttgaacctttgtttcatcttccctaacctctaattctatctctttagaagttaacttccaaaagcgaatgactgcatgcaaacccttctcaagcactgtttgttgaggaattctagcttaagacaagtgctattcagacagtttagctaaggctgggtccacatccactggaccctttgcttatttaaacatacagatgtttaactggtaccatgacccacatagctgtctctatgtgatgaggtctagccttctctgaaagtagttataattttattttatcatattttattttattttactgttcagtatggtgcagtagaccaagtcctgagctggcaaatatacagataataaatgttcaatatcattactcattggggaaattcaaattaaaaccccatgatataccactatacaattgctaaaaatgaataaaataaaatttaaaattctgacagtaccaagtgcttttgagaatgcagagcagctgcaactcttatatgctgctgatgggaatgcaaaatggcacagctactttggaaagcagtctggtaatttcttagaaagctaaacagacatttaccacatcattcaataatacactcaatcaaaatattcttcagttaatgaatagatttttaaaatggtggtacacccatgcaatgaagtaccatccagcaatgaatagaaatgtattactgacacatgcaacaacatggatgactttcaaatgaattatgctaagtaaaagaagccagactcaaagggtcatgcactatatgattccatttacatgatattatcacaaaaggtgaacgatagaggcagagaagagattagtagttttctgtggctggaggtgtggggaagggttgattacaaaatggtatggggaaactttttagatgctatagctattctatatcttgattatagtgtttgttacggcactatatttgttaaaaacacattgaaattgacattaaatttgaataaaatcgaataaaaacacaacgtaaaaatttatattttacattacagatgatttaattttattctatggacattatacttctgtaaaccagacttgaatataaagattatgtatcagtcaacaaaaacatttctcagagttgtatctatttttaatcttatctgggttccaagaatatcatttgttcttttaaaaatatatatttaattgaaaaataaaaattgtatatattgatcatgttcaacatgttttgaaatatgtatacactgtaaaatggctaaattgagctaattaatatgtgcaatatctcacatacttttaattgagttgtttttttagagaaatgtagaatgaaagtctaatatcttctagaattactaataaggatttcactattaattaaagtcaaaaatacactctgtgggagagcaacaaaaattctcactgaatggaaagaaaaaagaagtgaatatgtggataccttttacacagacatcaagttgaaaaactaaataacaaattgctttgattttctttctgaagacctactattataaagaaagaacaaatttcaaagtagaaaaacaatattcagaacaactgataaagaaagggggaaatggggttaatcagcaataagcaaaggtctaagcatgaaaagtcaatttgttttacagagacagcagtactaatatgctctctatatacagtagaaaaggcaagatgaaaagcacacatcttactactccagagagaacagaatgaatgtaattgacttaacaatcctcaaaatgacatgcagaaatatttagcaggactcattacataaactgaaagaagccttaaaccatatattcacactcagtccaattacaatgaacaaatttcctaaattagctgaatagaaaatgaaactatgttacaaatcaatggaaaatgaaactcacttttcagtttaatttatacatttccaggtaatctataactgtatagattacctcagataggtataggaataattactcacatatgaagagtgattttaaaatatcatccctagaaggaaaagtgagtctttatatttgtacagaatgaaaaatataaagttgatataatgtcttataatctattgatattcacatgcagatgttaaactcattttaaaaacaaaatactgctttgtttaagaaaatacctacctttgttctttcagtaccataaaagctataattttattttcaattccaaaacaaaaacaatttcaaaaacttacatttgtagttaaaaatcttctcataatagacatttgaatttgtggcacttacagtccacaagttgtcaaatggagctgagtgtcttgctggagccagcaatctcagggtgaagactctgaagccatgggctattgcagaagttaagcccctgaagtgcacatggaaatctgctcactgaatattggactgccacatggctgactagggatgttgtatgccagttattctttgaagaaagatcaaagttactggcaaataatcattttgagtggaaaatggagggaggatagccagaacctgtcagagtgcccacatgaagaagctggggagctcagaaaaaaaagtagcaaaagtctggatgagattgacccctcagccagagcccagcaaaaaggatggatgggagtgcttacccctctgacaatctgctgactgcaaaactgatggggagcccctctgtccctacgaccaacaacaacgctgtcagtgtcaatggcaattagagatcttccttagaatagagaactgggtggccagtttgcacagccatgcaacaccctctcacaccctggtcaagacagtggacaccataatagttgtgcacctgtggcaccactgtcttacctggagctccactcttgaactgcaatactacgagacctcccacagataatccccataactcactctgactttggcaagcacaaggaactggcagatctccaggaagttgtgggtttcttggagaactaaccctcagtgcataccaccccagggaagtggagagcacagactgccaaagcctcccccaggacaaaggaaacacaagtgcaagtgccaaccactgaagggggcaccaccaaaggctgggaacagacggggagaggggtcatctctcacccctgccccttccccagtggactgttacagacatgactatggttatttccaatggagcatgacgagtgcacactgggcaaggttgctttccccacttctccaatgactttatccctgctgaaggcaagcacaaactaaggagggttctttctgcacttaagtagctctaccctaggtggggatgaattcatgctgacagcctatagcctatctaccagctcctacacttaagtaccatctactggactgcagcctgaagtataccaccaaacaaaaatacattgctatgacatacagcatctgaaaaagcaactgcatgaacctatttgcaaccaaggaacccatacagaaccctggtcctctgagagtatccagatataacaccaatcagtcatacacaacatatgctacggtcataccctcgatggaaaaaagaataaaaaatttaaaagccctatccaagcaatagcatattcaagaaaagaagcatcacttccctcagataaggattcagcacaagatctctggcaatacaaaaagccggcatgttttggctccttcacaatggatcctagccagaataacatatctaaaatgacatacatagaattcagaatatgagtggcaaggaagctcaatgagatccaagagaaaattgaaatccaatataaagaagccagaaaaaaaatcttagatttgaaagacaacatagttatattaacaacaacaacaaaaaaaaacccacaaattctggagttaaaaaatttcctaaaataatgtcaaagtatacttggaagtcttaacaacagacaagaataagcagaagaaataatttcagagcttgaagactggtctttcaaatttacccagtcagaaaaaaataaaaaagaattaaaataataaccaatacctttgggaaatatgagattctgtaaaatgaccaaacctatgatttattggcattcctgagagagaagaagagaaagtgagtaacttggaaaacgaattgagggtataactcaagaaaatttccccaatattgcaagagacattggcatacagatacaaaaaattcatagaactcctgtgagatactacataagacgaccatcctcaaggcatatagtcaacagaatacccaaagtcaacatgaaagaatatcttgaaggtaaggagaggaaagggtccagttaattacaaagggaattccatcagactaacagcagacttctcagcagaaaccttacaagccagaagagattgggggcctagttttagtcttcttaaagaaaagaaatgccagccaagaaatgccaaactaagctttataaacaaagtagaaataaagtccttcccagagaagcaaacactgagggaattaatcaccatcagactgatgtaagaagaaatgcttaaggaagttctaaacatggaaacaaaggaacaatacttgctaccacaaaagcatatgtaagtacaaagcccacagaccctgtaaagtaactacacaatcaagattgcaaagcaactaactaacattatgacaagaatgaaacctcatatatcaatattaactttgaaagtaaacagcctaaatgctccacttaaaagacataaagtgggcagagcacagtggctcacacctgtaatcccagcacttgaggaggccgaggcaggtagatcatgaagtcaggagattgagaccatcctggccaacatggtgaaaccccatctctattaaaaatacaaaaattagctgggcgtggtggcatgtgcctgtaatcccagctacttgggaggctgaggcaggataatcacttgaaccagggagtcagaggttgcagtgacccgagatcgtgccactgcactccagcctggcaacagagtgagactcagtttcaataaaagaaaagaaataaagtggcaaattgaataaaaaaaaaattcattcatctgctattttcaagagacccaccttacatgtaaataacacccataggctcaaagtaaagggactaaggaagattcattcatgcaacaataaaaagcagaaaagagcagaggtcattattcttgtatcagataaaacagactttaaaccaaaaacagtaagaaaagacaaagattattacataatgatgagggtttaattcaacaagaagatttaactatcataaatatatatacaaccaacattagaaaactcagacttataaaacaattagactactagatactagtctggtagtgtctatctaagaaaagagatagatggccacacaataacagtgggggactgcaacaccccattgacagcattagacagataattgaggcagaaaattaacaaagaaattctgcacttatattcgacacttagccaatttgacctaatagacagctacagaatactctacccaacaaccatagaatacacattcttctcatctgcccatggaacagactctaagttctaccacatgctctggcataaaacaagtcttcttaaattaaaaaagaaatgaaatcataccaagcattttctcagaccacagtgacacagaaatagaaattaatttgaaaaggacctctcaaaaaccacacaaacatatggaaactaaacaatttgttcctgaatgacttttgtgtaaacaatgaaattaagaccgaaatcaaaagaaattttgaaacaagtgaaaatagagacacaacataccaaaacctatgagatgtggtgaaagcaacattaagaggaaagtttatagcactaaacacatatatcaaaaagatagaaaattcccaaattaacaaggtaatgtcacacctaaaagacctagaaaatcaagaacaaactagacccaaaactagcagaagaaaagaaataactacaatcgaggagaactaaatgaaattgagacaaaataaactactaaggatcattgaaacaaaaaatcgtttttgaaaggataaacaagattgatagaccactagctcaattaacaaagaaaggagggagagaagatccaaataagcataatcagaaatgacaaaggtgaattacaactgattccactgaaatacaaaagatcctcagagactcctatgaacatctctaagcgcacaaactagaaaacctaaagaaaatggacacatttctggaaacacacaacctctgaaggttgaaacaggaagaaacacaaatcctgaagagactaataatgacttataaaattgaattagtaatttagaaaatctatcaagcaaaaagaaagccctgaaccagatggattcaaagccaaattctaccacacatacaaagaagagctggtatcaatcctactgaaactatcccaaaaaaatcaggatgaagggattcctccataacccattctacaaatccattatcatcctgacaccaaaatctggcaagggcacaataaaaacgacaactacaggccaatatccctgataaacatagacacaaaaatttgcaacaaaataatagtaaactgaatccagcagcacatcacaaaggtaatccaccacaattaagtgagctttattcctggaatgcaaggatagttcagcatatggatattaataaatgtgattcatcacataaataattaaaaacaaaaaccatatatgatcatctcaatagaggcagaaaaagcattggtaaaatccaacatcccttcttaataaaaccacccaacaaactaggcatcaaaggaacatatctcaaaataataagatccatctataatagaccacagccaacatcatactgaatgggcaaaagttggaagcattccccctaagaactagaagaacacagggatgaccactctcatcactcctattccatatagtacttgaagacctagccagagtgatcaggcaagagaaagaaattaaaggtatccaaataaagagaaagtcaaattatctttcttcactgctgagatcattctatacctagaaaaccctaaaaactctgccaaaatgctcctataactgataaatgacttcagtaatgtttcatgatacaaaatcgacgtgcaaaaatcagtagcatttatatacgccaatagcataaagctgagagtcaaatcaagaacgcaatcccatttacaatagccaaaagaagaaataaaatgcctcaggatatatttaaccaaagaaatgaaagatctctacaaggagaactacatatgctgctgaaagaaatcaaagatgatgccaaaaatagaaaaatatttcatgctcatgggttagaagaatctatatcactaaaatggctatagtgcccaaagcagtttacagattcaatgctattcctatcaaagtaccaatgtcatttttttcacagaaatagaaaaaactattctaaaattcatatggaaccaaaaaagagcctgaataaacaaagcaatcctaagcaaaaagaacaaagctggaggaatcacattacctatcttcaaactatactaccaggctacagtgtacaaaacagcatggtactggtacaaaaacagacacatagaccaatggaagagaatagaaaacccagaaataaaaccacacacctacaacaaactgacctctagcaaactcaacaaaaataagcaatagggaaaagactcccctattcagtaaatagtgttgggacaactggctgtacatttgcaggagaatgaaactggagccctacctattgctgcatgcaaaaaataatgcaagatgcattaaagacttaaatgtaggacctcaaactataacaatcctagaagaaaacctaggaaatacccttctctatgtcagcattcacaaataatttatggctaagtcctcaaaagcaattgcaacacaaataaaatttaccaagagggacctaattaaactaaagagcttctgcacaacaacaacaacaacaacaacaacaacaacaaagatcaagggagtaaacagacaacctacagaatgaaagaaaatattcacaaactatgcatctgaccaagttttaatatcaacaatttacaaggaaattaaacaaatatataagcaaaaaacaaataaccccattaaaaagtaggcgaaggacatgaacagatacttctcaaaaaaagacatatatgtggccaaaatcatatgcaaaagtgctcatcatcactaatcatcagagaagtgcaaattaaaaccacaatgagatactatctcccaccagtcaggatgggtatgttaaaaagcaagcaagcaaacaaacaaacaaatagacaataacaacaaaaaacaaagaaacagatattggcaagactgctgagaaaacagacacaaaaatggttggtgggaaggtaagttagtctagccattatggagaagagtttggagattcctcaaagaactaagagttgaactaccattcaacccagcaatcccattactgggtatacgcccaaaggaaaagaaatcattctacccaaaagacacatgtactcatatgttcattccagcagtattcacaatagcaaaaacatggaatcaacccaggtgccaatcaatggtagattggataaagaaaatgtggtacatgtatgctatggaacactatgccactatataaaagaaaaaaatcatgttctttgtagcaacatgaatgcagctggaagctgttttcctaagcgaattaacacaagaacagaaaaccaaataccacatattctcacttataagtgggggctaaacatagggtagacatggacataaagatgggaacaatagacactggggactactaggttggggagagaagaagtggagacgattgctgaaaaactacctattgtgtactatgctcactacctgggtgatgggttcgatcataccccaaatctcagcatcatgcaatatacttttgtaacaaacccgcacatgtaccccctgattctaaaatcaaagttaaaaaaaaaaagaacacaattctaagaagtatgcatagccttacttagattttaaggtattatgaatcagaaaacgttaagaaccattgctctaaaataaatacaagtacataattttaacatggtgaatgttaaatgctctcacctcagtggatataatgtttagctgattagctggtttaaacttttttattttattttactttatttttatttttatttttttttttgagacggagtctcgctctgtcgcccaggctggagtgcagtgacgcgatctccgctcactgcaagctccgcctcccgggttcacgccattctcctgcctcagcctcccaagtagctgggactacaggcgcccgccgccatgcctggctaattttttgtatttttagtagagacggggtttcactgtgttagccaggatggtctcgatctcctgacctcgtgatccgcctgcctcggcctaccaaagtgctgggattacaggcttgagccaccgcgcccagcccttttttatttttaaaaaataagaattatgagtatgagactaatacttgttagtatgcatttggacaccgaaaaatacagtgtgtttctgtcatacaaccttctttcccagaacttaatcaggcattattgctaaaaataaagcaaaaacacactacacaataaatcaagaacatccacattgggatgtgtatcttccaggcaattaacaatacatatctgtgtttcaaacttttcattttgaaataattatagattcacaagagttgcgaaaaaaactgcagaggtagatcccatgtattcttcacccagtttccaccaacatgaacatcttgcttaaaaacagtacaatatctaaaccaggaaattgacattggtacagtccacagagcttatttagatttcatcattttgcatatttatttgtatatgtgtagtttctatgcaattttatccgtgtgtagatttgtataactactaccacacatgaagagttccatcaccacaaggctccttgacgctatccttttataggcacaccacccaccaccatctctaattcctagtagccaccaatctgttctccatctttataattttgttatatcaagaaaattttataaatggaattacatagtatgtaaccttctgagatgggcttttttccccctgagatccattctagttgttgcatcaatattttttttctttttgttgctgcacagtattccatggtatgaatatacaactataacattaacctgtggaggaatacttgagttgtttctagtttatggctgttaccaaagaaaaaataaaactactatgaacatctatgttaatatatatatgtacgttacatatagagaatatatatatatatatatatatacacacacacacacacacaaagtcttacatgtaaatgctgatatcagatgcattcataatagtaaaaaactcaatacaaaccaaatatccatcaactagattacagatgaacagtagtggaatatccacacccatacaataaagtattattcagcaattaaaatgaactactgatgcttgcaatgccatggatgaatctcaaagcattatattaaatagagttacaaatgagtacctacttccaggataggccatgtgccatgtcatatggtatagtttggatatttgtccctgcccaaatctcatgctgaaatataatcctcaatcgtggaggtgggacctggtggaaagtgattggatcatgagggcagatccctcatagatgggttgggccatccccttagtgatatatgagctctcgttctgagtttacatgagatctggtcatttaaaagtgtgtggcacctctccactccacacacactctctctcacttttgttcctgccatatgagatgcctgctcccccatcaccttccaccatgattgtaagattcctgaagcctccccagaagcagctgctagttctatgcttcctgtacagcctgcagaactagaagccaattaaacctattttcttattaattacccagtctcaggtatttgtttacaggaatacgagaatggcctaatacaccatacaacaaacctaaataaatgttttaaaataaaagtatcacaaaaatattctccaaccacaatgaaataaaactagagattgatagcaagaaaaatccctaaatttgtgaaagttaaataacacactcccaaataacctgtggagcaaaaaagaaatcaaaaaggaaaccataagatattttgaaataaattaaaatgaaaatactacatatcaacactagtagaatgctgccaataaaatgcttagaggaaaatgcatagttataaatttctacattaggaaagaagatctcaaatcaataacccaaccttccattttacgatactgaaaaaagaagagcaagacaaacctaaagcaagcagaagaaaggaaataacaaagattagggtagaaatacagaatagaaacgtaatagagaagaccaataaaaacaaacaaaaaaaagtttctttgacaaagtcaaccaaattgacaaacccttagttagattgaccattataaaaagagaggagattcgaattgccagaatcagaaataaaagatgaaacattaccacaaccttacagaaatataaatgattataaaggaattccataaacaattgtaagccaaaaattggaaaatttagatgaaatggacaaatttctacaaagacacaaactatcaaaactggcttgaaaagaagtaagccattttactagacctgtaacaagtaggaaggttgaattactaattaaaagactacccacaaagaaaagaccagacccagattatctcactgctgacttctaccaaacattcaaagaagaatgccaattcttcgaaaactcttccaaaaaattgaaaaggagtgaacacctttcaaattgctttatgaggccagttattatcctgataccaaaaacagacaagacatcacaagaaaagaaaactatagaccaatatctttatagacatggatgcaaaatctttaacaaattaccagtgaactgaacccagcagtatatatatatttatgatttatataaattatatatccaaattaactgaggtttattctaagaatgcaaggttggtttaatatcagaaaatcaattaatataataggatcaacggaagttttaaaaattacacgatcatatcagtaatgcagaaaaagcatttgacacaatccaaaacccttttatgattaaaaaaaaaacacccaaaaatctaggaatagacatgaacttcttcaaccagataaaagacatttataaaaaacccacaacaaatctatgcctaatggtacaaaactaaatacttcctcctaagagcaggaacaagacaaagatatccattctcacttctattcaacattatactgaagggactagtaaggaaaattaggcaaaaaagaaagaaagagagagagaaggaaagagagagaaggaaggaaggaaggaagggaggaaggaaagaagggaggaaggaaagaaggaaggaaggaaaaattaaaaataaaatgtatctggattggaaaggaagaagtaaagcaatctatatttgtagaagatatgatcttgtatgtagaaaatcctaagaaatccattaaaaaatattagatctaataaaagagttcagcaaggttgcaggatacaagaccattacataaaaatcaatgtatttctattcaattgcaatgaactaactgaaaataaaattaagaaaacaattccatttacaataacattgaaaatatttaggaataaatttgaaaaagcagtgcaaaacatatactctgaaaactacaaaaattgttgaaagaaattaaataagatcaaatagctgagaaaacattccattttagatgggaagatgtaacattgttaagatagcaatacttgccaaactaatcaacagatttatcttacttctcatcaaaatctcagctgactttgtagaaattggcaagcttactctaaattcatatggaattgaacaggaaagagaatagccaaaacaatcttaaaaaagaacaaagttggaggacacactcccaatttcaatccttactacaaatcaacagtaatgaggacagtgtggtactggcataaggatagacatgtagatttatggaatagaattgagagtacagaaataaagcctacatttctagttaactgtttttagacaatgatgtcaagactattcaatatggaaagaatagtctttaaaacaaatggtgctgagacaactgcgccacttcatgcaaaagaatgaaattagaccctatgcaaactttccttacacaaaattaactcaaaacagatcaaagcactaaatgtaagagctaaaattataaaatgctcagaggaaaatataggtaaaactatcacctggatttagcaaaggattcgtataaatgacactacatgcatgtgcacctcgtagaaatgacactaaaagcatgagcaacaaataaaaaaataggtaaaatgacttcatcaaaattcaaaatttgtttcaaaggatgccatcaaggaagtgaaaaaaaataatccacagaatgggagaaaaattttgaaaatcgtgtatctcatttgcatctaggaatttgcatctaatctaatacaaggaacttgtatctagtatacaaaacaaacacttacaattcaataaaaaatactaataatttttaaatgggcaagggatatgaacagacatttctgtaaaaaagatacaaatggtcagaaagcatgtaaaaagttgctcaacatccttagtgatcagaaaaatgcaaatcaaaaccgcaatgagataaaaccaaagaaaatgagtagaatcaaaaagtcagataataataggtgttagcaagaacgtggagaaatcagaaccctcatacaccacaggttggaatgtaaaatgatgccaatgcttaggaaaacagcctagtagtttatcaaataattaaaaatagagttaccctatgacccagaaattctacttcatctaggagaaacaaaaatatatgtccatacttttacacaaatgttcatggtaatatattcataacagccaaaaggtagaaacagctcaaatgtctatcaactgatgaatgtatttaatatcaaccaaatgtactatatatatatgtaatggaatgttattcagccatagaaaggaatgaagtgctgacccatgctacaacatgaatgagccttgaaaacattatgctaactgaaaaaaagacaggcacaaaagacaacatgttatatgcttccattcatatgaaatgtccagaacaggaaaatctatacagaaagtagattagtgattgctcaggaccgtggggatagggaggtaggggaatgttatctaaaaggtatgagatttatttttgaggtaatgaaaatgttctaaaattgactgaggtgattgttgcacatatcactgaatatactaaaaaccattgaattgcacactttaaacggtgaattgtatagtatgtgaattatagttcaatgaagctgttacaattttattaaaagaatacctactgtatgtttccatttatacgaaattctagaagaggcgatattataatgacaataattaagtagatcagacatcatcatggaccatgtattagtctaattctcatggtgctattaaagacgtatccgagactcggtaatttataaagaaaagaggtttaactgagtcacagtcccatatggctggggaggccttacaatcacggtggaaggccaaggagaagcaaattcaggtcttacatgatggcaggcaagagagtcttcgcaggggaactcccatttataaaatcatcagatctcgtgagacttatttactgccacgagaacagtatgggggaaactgcccccatatccaaaccacatcagaccaggactggggagagggatggactgcagaaaggcccaagaagaattttcaagtttatggaattattctacgtcatgattctgtggtggtcatgttacagtatacattgtcaaaacatcatttgttcatttaaaattaaggacttttaatatattgaaattatatctcaaggctgattttcaagataaaaatttattttcaataccaagtgatgtgagattttgttaggtcatgaattttctaggcaaaataccaatgccaagtgacagcacaaatattttgatagccttggtaaacactaaatactttactatatccagtttttttacaaaagcagatttttacacatcattgcaaagtattcttccattaggtggtcagacattgacacatttggtcataaatgggtcccaaaacacatatctagctttgagataaagacctttagttatatgatagaatctataaagtggaaatcatatatggatacaaagcagtattcttccctaaatagttattcagaaaacagagtttcttcatatgcaagtctttatatgttttctcattacagagtactttctcaaatactttattttgaacttgtcaaaattgagtctttaaaaaaatagaaataaatttaacacagatttggtgtttttcctggagaaatgatctcattatggcaagattggatgtcattgtaaacaagtcttttaaagagcaatccagaaagtgattacactggggagatccggaatacaaacctacaggataaatggtggacctcatttacttgtatgctctagtaaaattaatataccaaagctgaatggggttgaattttaataagctaatgtttggggtccatgtgcaatgattctggttgttaattgttagtaggtgaatgcacagtcatgttctctgggcctaatctactggtcttgctctaccttgggagagaagggtcaaccagtcaagggatatgctgaaacaaaataggaagctacatctgttatggatctgttatgtcttgagaccaagacatctgcccatcagagctgtggccaatttcaccgttagtggatgtgcaagtttcgctaggaacacactgaaaagtcaaaaacagcccattagtttcccagagaatgaataacaagcataatgataatgctcaattttaaagggggtggtttcacatacctcaaatatttccatgacagaggccaaatagcataatgtttgagaacatggactgtgaaaccagacagcatggctttgcatcttgaatctaccatttataaatcactaacctttctgtgcctcagtttcctcttctgcaaaacaaggatattagtaacacttaatatctactgggttgatgcatgggttgaataagttagtagatgtaaagtgctcagaacagtaccaagcagcatttaagtttcatttatcacttgaggtaggataggcaaatgtcattatccccttttcacagatgggaaaaaggcttagaaagtgtgagtgaatcacacagccaaccagtggctgagtcctaaccaaactgttcaacttctgactctagtgttctaccctgtcagtcacacatcctgatatggtttggatctgtgtgcccactcaaatttcatgttgaattttaatccccagtgttggaggtggggcctggtgggaggtgactggttcatggggatggtttctcatggcttagcaccatcccattttatactgtccttgcaatgatgagtgaattcttgtgagatctggttctttaaaagtgtgtagcacacagagaggggaacaacacacaccagggcctgttagggggtaggaagtgagagaagggaacttaaaggatgggttaataggtgcagaaaaccaccatggttaataggttaacaggtgcagaaaaccaccttatacctgtgtaacaaacctgcatgttctgcacatgtatcctgtttttttttttttgtagaagaaataaaaaaaatcacattatgcactgaaaaaaagggggtagcacctcccccatctttctcttgcttctgctcctaccatatgggacatctcgtgcccccttttccaccatgattggaaacttcctgaggcctccccagaagcagaagctactattcctcctgtacagcctgcataaccatgagccactcttttctttataaattacccactcccagttatttctttatagcagtgcaagaatagactaatacacatccttaaattcagaagcaaagatgagcctgtctcattcaacggtaagaaaaccaattagcaaggatccattcactttctcactgggacactttagaaactgcaaaaacttgcataggccattacatcagtgcttttcaaaacgccgtcagagggtcacatattcagttcagtgggttgcaacttttaaaaaaagtaaaacacagtagaataggaaatataatgcatcaaaaattgtaagggtaattactgtattgtgatatgttggtttaaatacatacattctgtactcatgtgcacatatgcatgtgatagacagtattatttcccacaattattcaccccctgggccacctgcccttccttgttggagaattatgccagtcattgtactctgttgctagctcacttgcagggttcctgtgaccgtggtgtgcttccccaccatattgacatttgagactcactagagtcaatggagtgtaagcatgtgacatataccaagcctgagcagtagtgtttagagcaattatataggttggctcagtgctttactctttcccttcgccagaagctcatcttaggatggggttgctgccttacgcagagttctggaatgacaaacaacttggaacagtgttgtggcccttctacagactagaagagagagttacagcctagatcagagccaccactgatgaacagcctgcatgtacataatgaggaattaacctttgttttgatacccctgagattttcagttgtttgttaccataacataacttggccaaagatgactaacaggtatgtttatgtgtattggattgatgagataaatgtatttcttactgaggaaggtggtcaaaaaatttgaaaatcacttgattaaataactgtctcagtcagtttgggctgctataacagaatctcatagactaggtgactgaaacaatgaacatttacttcttccagttctgaaggttggaagtctgagatcagggtgccagcaggattgggtccttggtgaaggccatcttcctggtttacaaatgttcgtttttttgttgtagcctcacacggtggagagagtgtgagctctggtctctatattccttcataagggcactaataacattcatgagggctccccactcatggcctaattacttctaaaatttccacctccaaatgccctcatattggggatttaggctgtagaatttaatttgcggggacacaaacattcagtctatagaaatgaccatttagaaacttgattctttaagaccagcctggccaacatggtgaaatgccgtccccactaaaaatacaaaaattagctgggcatggtggcatgtgcctgtaatcccaactactccggtggctgaggcataagaatcccttgaactcgggaggcggaggttgcagtgagctgagatagcatcactgcactccagccttggcaatagagtgagagtctgtctcaaaaagaaagaaacttggttctttaaaacattagtttagttcacttgacacacttaggtatttctctagatttcccatttgtttatattagtttgaaaatgcttcacttgtatttttatttttgtctgcttttcataggacacactttaattccttctatcatataagaattagaccaatattttttcaaattatggcatctgtatatcaattaacagattttcagacatgtgcactgccttacatagaaaatgaaagaatgcaatagcatttattatttagtggtaataataattacatgttaatgagagagattgttttgtaatatactaataatataaactaatatcataaatgaagtaaggtacagaacgacatctgggtcaaatgtagatccagattacgaagaccatgccagctcattatctgacactgaagataataatcataccacataacacactcaaatgttggaacttgaaggatcaaagtgaatggaatcctaatcacctctggttgtcttcagctctggaaagtactttttcttttgctgttgcagtttttggatgggtgtttaatcataccaaaaaacatgtcaatgatttctttcacagttgagcgggagtgagggaaacacaaagcatttgaaatgaattcaacttgcaaagactgaggtgtttgtaccacaatttgttcttaaaaaatcctggtgtcttgtctccaacaataaaaaaataatgacaatgcttccttgaagggataggtgcatgcactcaaaactgaataaatcactgaaatctgccacttgagcaaaccatctgaaatgatagaaacagtctctactggcatcatcattgtaatgaagaaatgtgatttttaaatcccatctttcatcttcaaggttcacttaagcatcttattccataacagaagtgtgaaaacgtagagttttgaaactgctacatatacttttttacagtattctgttaagagttaaaatcaatagccataatttattaatattcatagtttttactatttcttgaatattaaaccaagatctggagacatactattttctataaatagtgatattagattgataatcaggcacaacttctttaattcaaaatccttcaatgcttcatatgtagttgctgctcctttgctactgattacaacatacgttttctattccacctcatagttttctaatgaccatcaaacaaaatatctcatctgcagaatagatgctcaatggtaaagaaaacagaaactcatctagcacctccctctcttagttatgccatgcataggctaagaaactttgacatggtatccaattgtgatgcaaagcacctgcgtactcacacaacgtgctttcttctccctgatgccacttgcattatataatgaccatcagcatcacctgatgaaggaaatttgctgaagggtcactcggctttctctccaagtatgttgctaattctgctacctttgccctgaggatgcaaccctgcatgatgcttttgttttgttcccttctctgtccttatcaaaacaattcatcaattttgtattggaaactttattttgcatttcccattctgagaaaaaacaattagtttaccagttaaaatttgaagaagataaaaaacataaatattttacaacattattgaattttaaaagttgataaggctctgagaattggactatctataggtcccatacaatccaacttttagatgttcatcattatactttttagacatattttgctgttttgttgacttccacctaactttgtatgtcctaggaaacacagatttggatttagtctttatgcttacaatttcatcttaagctaaagtaaataataaaaagtaaatcattttacttgtttcatcactacttttaagcttgaaccatttccagccatttatttattttagtcaattggtagaataacataacagcaaaaaatgcccatgtaataaataatagcacaatgtcataaaattagttgagatgaactgtaccttgttatctacttggaagagcattaaaaaatgcttttatgaggctattaaatgacacttcaccactggttaattcctgaatatgggggtcattgactagtgttctcatttacctttccaattcaggccttcttcaaaaagtcaccattctttcttagaaagagatattaatacagcctctattcatattaaccccaccatgttatcatcattcttctgattcaaaattaataaatactgagaaacaaattttcctctatcaaagggacagttttactttttacttgtttctgtattcagtccaatcaataacatttttaagttgttggtggatattctgaatattgtaatttttatcatttttaaaggggcaattttgtaaaatgacaagaccataaagggctacctttgcatgttctctgctatagaaaatcagatgcacttgtttttagagaagaaaaaaaatcattgttgacaaaactcctgtacaaagatctctaatgcctttggccagtagtcgtcataccagatgcagtctttttaatgtggacctttttggtttagtccttcttaatcttttaatacaatgatgattagattaaatgggaatgtatattgaataaaaatttgctagcaaatatttttactataacacattattatatgagatattttaatcagctgttaaaatttgatacatgttgatattttcagtatttatatggctaatatagctacctagagcatccaacaatgtgtaattaaaaatatttatcattaccagaaatacaaaagaagttgtggttaaaacttaggctttgatgtcattctgaactgggttaaaaccttgtgttctcacaaacgatgtgatcttgatcaagcaacaacttctcgaaatctgtttctttattactactcagttgcaagccacataagggtaaggaccttatctactgagctaatattttatcaccaacatttaacacactgccttgaatatggtagtcaattaataaatattgaatgactgaaataatacattgaataatgggggcagtaatataatttacctcatagggtagatgcgaacgtgaaataagattaggcatgtacagatccagaagagaaacatgattaactagctattattagggtgaccatataatttgacatacatatcgggacacttcagaataacagagggtgccattaatagttacatgggggcaaaagatgtgaactaaggccatccaagtcaaactaaggtatgtagtcaccccagctctggcaaatattattaggcaatataggaaaccaaggatagaaggaaatgtgtaattgtagatacgtaacatataattatttgacaatggttgcaatgtagacaaataaaaccacagcaatagtgtctaacctggcaaaaactgcccccacctacctgctcgaagcattagagagaaggaacagtagaaaaatgacgtttcctgagtccaaatttccacattgggtttttcagattcgtttaacttaccaagttgaattagattaataattctctttcaagattccttgtcaaatctctcacagtgattgtttttcacctctcatatttctggccccgccctgtctgagtggaatgtttcaacttctaattcgacaatttacatattgacctgtttcctggccaatgtttgttcttcctcaggatatctctgtactattacctgttctctcttccacctcttctgtctataaaaaagatacatctttcctttaggctatggcccttcacctcacagacactttacgtatgtatgtatgtatgtatgtatgtacgtatgtatctatgtatttgagacaggttcttactctgtcctccaggctggagtgcagtggtgcaatctcggctcactgcagccttgacctcctgactcaagtgatcctcccacctcagcctcccgagtagctgggaccacaggtgctcaccatcatacccagctatttttttgtatttttagtaaagatggggttttgccacgttgcccaggctgggacactcttctcatcatagcctccaagatgttgttctttttttttttttttgagatggagtcttgctatgtcacccaggctgaagtgcagtggtgcgatctcggctcactgcagcctctgcctcctctgcctcccgggttccagggattctcctgcctcagccacctgggtagctgagattacaggcatatgccaccacgcctggctaatttttgtatttttagtagagatggggtttcgccatgttggccaggctggtctcgaactcttgatctcaggtgatccacccgccttggcctcccatagtgctgggattacaggcatgagccactgcgcctgacccaagatgttcttctatcagtttttcactctcttcttattggtgtcttcaatatctccttcctgataagattcagaaatctggatcttatgctctggaatcataaacatttatgttctaattctgggttttcgatctctgtgtgatcttaggaaagctggttaacatcattgagcctcagtttcttcatggtaaagtggtaattgtaatgcctagctcaaagaatagcaaggaggattaaatgagataatgtatataaaatgtctaggagacttctgggcaagacattggcaccttagattcaaacactggtgcacatcctctcctctaagcaaataataagggtaggcagaaccttaaaagagaaaagtaataacatatgtggaggctaaaaaataagataaatctatctggaaccaaaaactgaacagaaatacaaagtcataaaaggagctgaaaatggaggcctgttggactctgtttccgaaataggcagtggctaccaagagctaggcttctatgtgtcaacaaggaccaaaggaaaggcacacaagcgaggcaactggaatcaggagtgacagggatccagtgtctggggagaaacttttccatcccattggcagcaccattttcctttttcaactacaggctgcagttgttttccacacactcccatcttaaggcgcctgtaagtgccgtgttcataattcagtttctatttcccttcccataccgctacacttttattgaatgtacattttgcattcctgtgaaaaactcacagtgatttatactgatatcccagtggagcaggaacctcaaggtgacattataaggactcagggtccagctgctgaatgtagacaactgaaagagggagcaagaggagggaaaagagggaaggagagaaaagaaaataagaacaataaacaaaagtaaattaaatactgattcatctgcagcagaatttattcctgaaaaaatctattttataaaggaaactgacaatggctttaaaataaatgtttcaggtatttaaagacaaaaatgagtaaaaccatgaacataatagattacaacacatagacttgggagaaaagaaataatgatgagtaaagaaactgatgaaatatgtcagcaaatttaatgaagtattgactattttgggtgtgtgttaaacaacactgtgtttagagaaaaaaaacaagatggggaaagggagcaatttggttaattaaattgtgataagtaggaggatagaaatgattaaaaatagatttgtttaaaatatttatagttaaataggtaggtgaaaaaaattcagggttgccactaaaagtaaacaatacaatatatgctttctgtatttgttttctacatctgtacaacaaattatcacaaatttagctacttataaaaatacatacattatctcagagtttctgtgggtcaggagtatgggcacaggctggctgggtcttctctgttcagtgtctcaccaggctgcaatcaaagggtaggcctagctgtgtcctcaagtgaaggctctcttagggaaaaatctacttccaagcttcctaaggttgttggctgaattcaggtccttgcagctgtaggcctggaatcccagaattcctgcaagtgttggcgagacgctgctctcagctcccaggaggtatttccacgtcgttgtcacctgactccctctataggcagttcacaaaatgactgtttctttgaggtcagcaggagaatctctcagactcctgtttctgatctctaaaccttcatttgaagggctcccataattagatcaggcccaaccaggataacttccctcttcattaagttaactgattagagacttaaatcgcatcttcaaaatcccttccccttggctgcacaatgtaacctaagcactggagtgctgtcccatcatatgcaccagtcctgcccacactccagggaagattatacaagaaggtgggaattttaggggccatcttagaatctgccaaccacagtctgtcctttgaatccccaatgatttacattcctcccagatgcaacatgtatttacccctctcaaagttcccaccagtcttatctcattacagcaacagcttacagtccagtaataccatatgtttgtatgtgtatatctttttcaactgaaaaggagcaataagaaacaaaaatgaatgataaacagaagaaacaaaaaattgtagaaagaaatacaaataaaccaataatcacaacaaacataaagaaattaagtttattttttaaaagatatagattttttaaatgagtaaagtgcacagagtccagctatatgtttcttaaaaaactacaacaaaatgcagaaagattaaaagaaaggaactaaaaaatatatgccagtaaaattgtaatccccaaatatctagggttctaatataacatcagataaaacagaacctaaatccaaattattacagggttaaagaagaatactactaatgatacaaaaataacttcctaagatatataataataattaatttatgcacatctaacagcattctctctctctctacacacacacacacacacacacaatcatattgaaactgggaacttttaacacaactctattaagtttattaacttaataatagtagaaaagatttgaaaacagaatgaacatgtttgatgtaatgaactataataaaatttgtacctctatgttcttttcaagtacaaagatgccatttacagtaattaactgtatcataatcaaatgtcaacacatctcaaagtttcaatatcatagcgactatgttatctcactgtaatgaaattaaaccagaaattaaaaattaaaagatagataaaagatcatatatttagaactctagaacattcactcctaaataacataatccaaaggaaaataacagtgagagaattacaaagtatttaggatagaacaccaatgaaaagacagctgaaactgcaaaattagtgagatgcagataaaatatttacaggtaagtttaaatggatctattcaatatcaagaaagactaaatataaatgagttaagtatttaaagatctagacaaagaatttagaaagagtaactcaaaataatcagaagaaaaaataacaaacataatcaagaaatacataaaatagaaaactataatacactggggcgaatgaacgtgaccacagcttggttctctgagaaacagaaaaggctgtagcaagactaattttttaagaataggcataaataaacaataacagcaagagaaaaggagaaagatacaccacagatactaaaaatgcaatagtctgagaatcaaggtaattacattctgcttgttgatgactgaggtaggagcaggcatatgacaattcttgtgaaaaggacaatgagaaaaaaggagaaattttgctagaactcttcttgaaaagtattatttgcttttaggaaaggtcagaagacaagaaactgccccttcctgattttggatgttgttgtctgaagatgtgatggttggtactgtggcaaccacattggatcatgagggcaaaaccaagggaataagagaagttaacaagaacattactgagcccctgaagaaccaaccctagaaccgccctattttcagattcctgttatgtgagataatacagtatttatgtttaattagctcttataagaatattctatgacttggagccaaatgcattctaacggatataacattctggaaccagtttcttaattttgttttataaacagattataaatagagaagcaaagtttttccaactggagtggaataatctgagaggccttctctcatggatggctaatatggtacaggagtcatgaatgaagagaggctgttatatagaacgttctgaactctgatggaggtgctgaacaataaggaggattaacaagtgatgtgacagaagctatccaaagggaaaggaccaatggctcattccccacccatttaaggagccaaagctcttggcaatctgaacatagttatcgattatacatacccttcatcctcataactcttcaaatgcctttattaaacaagaacacttcttgcatacattacctacctggacacaattctaaaatatttttggtgaatgaacagctataagccatgcccttccattttccatttccattagcatgcagctgaacccaaatgtaaaaaaataattttgtgatgatattcattaatttggaaaagtaatctcagcaagtatcttagcaaagtaaatctttaacataaaaaaatgctgatggcacacttactcagattttggtgggcgacgttctcttggataccagttatattctcatttgaatttcctgtttcttgttttatgtgcatataacttccttttttttccataaaagtacctgaaattggagtgagattcttgtaatgagttttttcttgcaatatatttagatgaacaacaacagtatggtattcctaagatcctgttactcctattccttaatggaaacatcgtgttactgattcttctcccactggaggaatatgctttgaggactgaacttttttccctgtctctctctcgtttattgggaaaacaacgtcatcgtcttcttggattgctgacatttggataaggcagatgaaacaagtaagtgtcctacgtccagatagaaatagcaaccatgcacaaaattttcttataaaacagataatagagtgactataatagagactagaccagaagtctggattcttgggtccaactgttcaatcttaggcttgttctgagatgccggaaaaaaaaaaaaatcactcaagagtcttttggtgcctttttgggctgcacctataaatggtaattatacttttctattatagagttctccaccatctattgtgatgtgtaactatatcaaaggagtagttgacagcttagttaatgcatagagtataaatcacgttgagtttctcacaggaatacaaaatgtacattaaatacaaagtctagcagcatgagaagggaaatagaaactgtgaatcatgagcacaccacttacagatgtctcaagatgtgggttatgtggaatacaactgcagcctgtagttaaaaaaggaaactgatgctactggtgggatgggttgttttctagggcagggctcaggagacagacgagacagatttctaccctcgacttgaaaatgggccattgtgtgagccttggcaactttggtacagcctgcagcgactaaaatggcctggcccctgcccacttctctattattagatagattgcattaacggcccaattcttcatcctttcctgtatccttgcttttttgccatggggttttaagcaactcctacaaagaggtagagtatatttggggtatcttgatttagagtttggccatgtgacttgctttggctaatagaattttagtggttgtgatactaacagatgtctagaaagtgcttgcatgtatttggttttgctcttgctcctctgggatggtgaggggaacatgccctggctaggctgctgaaggatgagacatacagaacagagccaagctgcccaggtgttccagccaaagccaacctagatcaaccatcagccagctggttcccagacatgtgaataagccaaaccaacaggaaaaattgcccagttgtgcttgtcctaaataactgactcccagactcataagcaaaataaatgcttattgttacaaaccactgagttttgagatgatttgttatacagcattcttgtggctatcaatctgatatactttccaacacttccctgttgctctccacacccactccagcaacattagacttatctatttaagagaacttttcatgtaccccaggacaggatccttgcacatgctgttctccctctgcctggagctgtctcttatgcgtctcccctggccccttacgttggccagctccttagctgaaatacatttattcatcagttcttagctcaaaagtagcttccttaggcaagcttttccttccaatccagagtaagtgggctttctttaaaattgcaatatattttcatgtatttgtgttactttatatcagagaactttttactgatgtctctgttaatgaatgataatctaatttttttgtgtgtgtgtgatagttaagctggtctcctccatgaaattgcaaagtccatgagtttagaggctgcaactgttatctgggtcgccactgtatcctaacgcagcagataatatagtgtattaggtacacgctacctaatgcagtgacaggcaccaatttttattgaatgaagatgtaagtcgtatcctccaccttttgtgtgtgatgactgatgagttacatttgtagccttctcgagaagtatgctttgagtaactggagctgcctcattcaaagatacctgagaggtacacaaataagccctctcccccacaggaagcctgtaatcagtgactcatagatgcagctatggagtagtccagcctgcttgcctctgagtgagataacctccgtggtgtaatttatgctctagagctccccgtgagatggggcctaggcttgacttctaaaaccacatctttgccaggttcctttccctgcactaatctatgccctcatcttgctttatgtttctcctgagaacttgacctcaataaatcacttgcaggaaaattcctattttaggttctacttccaaccaaacccaaataaagacatgcaataaatttgagcatttcttgctcaaccaaaaaataaaataaccaaaagaaccctgaaatagtatccattggtataaatctttggatagagaaaaattatagctcactcttctcaaagggtccagaaattcacagacatctgataatttgggggttggttagaacctccatagttattaaagcaaagttttattcattcctggaaatgtttattctcaaattgtaccactatacactaatacatttcttaacagcactattcaagtagagagcatgtttgatgtctgactgccaggattttcatctcccctgtatttgtgggtttctgctttcagaagataatcagagaataggtgatggtggctagaaaaacgcccgtcatacagtcttaaaagaaaaattatataaggctacacatagtgcaatcttaaataataaaacaaatctatccatctctctatctaggcattgaaaaatcaatgaaagaaagcataccaagatgtgaacagcagtagtaaagttctgagagatttttatttcatcttttacaattttacaatcttcacattttaaacagaaagcatgactgtggtttttgaaaaaatatggtttaaaaaaagggtaactcagcaaacagatcaaagagagaacaatagcacttcctccccctccccccaacctcaccccctgcaaatgagctctgtacaaaagtaaatttctggacattctacatcaaatataagatggctttgaaaggtggagaaaatcagatctcctagggatttaaggaaataagacacaacacagtggtgagttccctgggttttcattttgcctcatatatcccagagttggaactgaagaaactggagaaatgccaatgggcacagacaaggaaaccaccaacaaaagcctgttgtctgtagccaaaggaccaggaaggggcagcctaacaaggcaggactcttctatacccactctacttcagtgggacaccacagaagcaacctgtgaccccagccctactgaagcccatgaaggctgattggggagctctgactttcaccctcactagactataaggaggaacccaatctctctgcctgggtggtattagaaaggctgagtagagagttggtttgttgatctcttctagacagtaacaagacttcccacctcctacatggggtcagtggagaacacatggggagcctggccttccacccctgctcagcggtaaagaggcatcccccccaactattcactgttgtggtgtcagaggaggcctaacagacaggcaggacttccaccccccccacccccaagtaaagaggccataactctcttctgtggtgctagtggggccatgagggagtgcagcactaggcattccttgctctccaagcctaggggattcagtcagtggaggcgtaatgaaaagtcagagtgcccacccacccaggagtgataaggagcctcacttcaggtgtgaatgaaggccacctggttgtccacccaacatggcagcagtgaggtatctccttcctcctctgctggagcagagttagaggaagctggctcgaacagatttaaacaagatccaaagtctcagaaagtaacatccacaatgtccaagtttcaatcgagtaacatgctttatactgggaagatctcaagctgaatgaaaaaaaaggtgatccatagatgccaacacggagatgacaggaatggcagaatcatctaacggacagtttaaagcaaccatcataaaaaatgctggcactgaatagttatgaacacacttgaaacaggaacaaaatagaaagtttcagcaaagaaacaggatagaaagaaccaaatggaaagtttataactgaaaaatacagcaaccaaaataaaataaaaatggatgagctgaacagcaaaatggagggcacagagaaaagcatctgtaaactggaagacagaatgatagaaattacccaatttgaacaatgcagagaaaacagactgaaaaagtgaaaacaacatcagggacctgtgggattataacagaagagctaatatttatgtcaccgaactcctgtattgaaaggagaaagtggggctggaaacttgaagatataatagttgaaaatttaccaaatttggctaaagacatacacctttagaatcaagaagctgaacgaaactcacgattttcaagaataagtctgagtatgactatgtaggttatgaaagccaccagataatcactttgttcagattatgaagttgttgtttttaacctgtgaaaaggactcagagaccatcagtgatgctacagtaacagtgttagacagtgtctagccagagtgactagttatgacttcagttagcccaggaagattcaaattaagtgtagaaatgtttaagacactccattgttcaatatttttgtgcatttgatattttatgcattttccacatgtaagaaatatttggattaacaggtcagtgtcctgttttcatacaatctaacatgtatgactaagcatacatgttcagtctaacatgtgtgactaagcacgtgataaaaaatttgcaattttaagttgaaatcttactgagtatgcaggcagtatcagcacatttaagagaacttaagaatttcttgacgatttttaaacttttttgtgagaatttcttaaatggagcggactagcataaaattgaaaacaaaactataacgaaatatattaaatttgtacaggcagtttgcgtatttaaaggagtttcattgtttgaaaacatgaatcaatccccttaaaggtgatttttcaaaattgaatagatttataaatagaatgagatctacaaattcagaaagttggctttaaaatttgtaacttaattattcacatttaaacctctggaagatcttttcaatgcctaaaacctgcccctaaagacataaaatccctcacactaacatatacatgaacatgtggtatgatcatcatctatgggaaaaatcttgttaactttttctagtgtggaaacactagaaaagtggaaacttggtcgggcgcagtggctcacgcctgtaatcccggcactttgggaggctgaggcaggcggatcatgaggtcaggagatcgagaccatcctggctaacacagtgataccctatctctactaaacacactgcactccagcctgagcgaaagagcaagactccatctcaaaaaacaaaacaaaacaaaaaaaccccagaaaagtggaaagttgcattgcttctccaagtcctgtccagttcaagtgagtagttctaagcatgtctggattactcattccttgagtagagattttgcctctatttaatctctgttatcgctgcagctgccatggtgccagggaagagcagatggtagagaaacacgtgtttgaattcaacttaatcagctacattttccaagctctattttaaaatggtgtattctgcgacagtggtcctgaagaggtttggcttccaaggatgaaatgactcagaagaacctgaagctcaccagccatatttgcagcctgagcactcataggatgacaacgttgagcagaatttagccccctccagcactctgttagagtttgggaagaactgttagctgcctggaacatgcttttttgtatactcaggaggcaaagttctgccatgttgcctttaaccagccatgtttttgaggtgctgattgtccttacacaatgcctttttctaagtagcaagcttcacccccatgaaacacctcaatatagatcaacatactgtttgacattcatcactggaacaaaatgtggcataatttcaaatactagaattttagacactgcacttcaaagttaaagagacttacagcaacatgaaaaagtcatcaataattacaacgcatattatagaaaaaattaagttctatatattgaacaaaactgggtggcatatccatgaaatacatgctctttgagaaccagtaactaattatattattccagttaaagatctaaaactaagatgagttttcattctgagacactaaaatgtaaactgagtgagatttttaaatgttatttgaatagatcagctttaaaacaaacttacttgggtttgtatttaccatatttttttgcagtttaatatttatccccccaaaaagtatattattaaaagaacagtataacttacataagttttcacaatcatagaacatttgtaaattagttcaagatctcagagaaatgtgtaaaagcatttgtatctttttaaatttaatatatttatctaataagtatactcttgtctcacttaactttatgcagtgctttttcttttggtaatttttgtctttattataccaatgacccatatttactatagtaaattaatacatataattgaatcagtgtgtctcaaccttggcactattgacactttgggttgaataattctttgctgtggagggcagaccctgtgttgtagaatgttcagcagcatccttggcctctacctactagaagtgaggagtgtctccagtttcaacaaagagaagcgtctctagacattgcaaaattttcccagggagagcaaaattgtccttagttgagagccactaatttatgaaaagaaaacaaagtcacccatttttcttccacacttatattttagtttatattgttatggtcaattttctctatctatacagatatgtatccaagtatctagctataagatattttatatatggaatatatataaacacatttaaaattagcattattacttctcttttgcagcatatattatgaacattctttcacaaaaacgtatatgtttatttcctcatttttaaaatggctacacgatattccactgtttatacacaatattatttattccatttactacttttagatattgaagttattcccaatgtttgataaaagtgtgcctttggttgggtatgatattcttgggaaacacattcttcccctaaaatttttgcagatttgcttcactgtcttttggtatcaaaaatggctgagaagtatgagtccagtaaaatttcttctcctctgcatttgttcatctgcatgtttagtcaaggaacccaaaggattctttctttattcttaaagttaaaaacctttgtctttaaagtatcaacttgctgatatttcctgaaatacagtgtttcttttcagtcttttggcacaatttcacattcatttcaataaacttttattctattatatctttaaaatcactttcatttttagttgctggtcttttctactttaagcacaccaattatccttatgttggattgtccttgtcctatgtattattgtctcctagttcctttaatttctttatttccccctctgcattcatggtgaatcatacaatccactattttatatgtttccatttttctggcatcttcattttatttatttatttattattattttttgagatagagtttcacttttgttacccaggctggagtgcaatggcacaatcttggctcactgaaacctccacctcctgggttcaagtgattctcctacctcagcctcccaagtagctgggattacaggtacccgccaccacatccagctagtttttgtatttttagtagaggaggggtttcaccatgctggcccagctggtctcgaattcctaacctcaggtgatctgcacccctcaacctcccaaagtgctgggattacaggtgtgagccaccaggcccggctggcattttcattttaatgaatccgtaacccacatttattatgttaaattagtaaatgtagttaaattggggtttctcaaccttgacactattgacattttgggtagaaaactcttcactgagggtgggggctctcctgtgcattgcaatatatttaggattcattactttttgtgatttattggtcagttcttgaatattgttttcctccttctccactgattttcttacctcccttttcttctttttctgtttttatgtcagtatttgatcacctttttgtttattaactgaattaatagttttattaagtattacacgaataggttctttagggatttaaaaaatgtttttcttcagttatatgtttttccaaaagggattatttgtctattatgggtggtgccttcgtttttctgcctttggcttacccctctttcctttactgaatagcacagatgccatgttgtttctgtttcttgttttcttggtcatgatgaacacagcagctgtctaccttctctttgttctgatatattgtgtgctaattctctctgatctccttatctgagatcagttgtctacctccctgagagctgggaagtgcatatgcaatactttcctgaggctgtgtgccattggtggaaatgtgttgtgtgtagcggggaggaaaggagagggtggatgggagccgttccgctgggcctgtgtgcagtcttgtttggaagagctgcaccatgctgtctcctctgtgattttgctaagcatctacctagttggaggcgtatgccgttgccatttattagctctggatggtgagaagaaaagacgcccactggctttcagcacagagatttcaacctttgcttctgtcacatagatcagcccaggcattctgttttcctgtttcacctgttcctacccagaagccatttccataccctaaagaagtggcactatgaacatttttgaggctgttaatctgtactaaaaaactgacctccagaaacgttatactgattacatagtaaatactaaattaatgaagagtatctactttcttatatttttgtcaaacttgaatattaatacttttatttttaatactagatttttataaaaaataaaagtatgagaaaacatagtttaatgaatttcaatgtatgcgaatattttacaaatttttttgaaattcacacgcaatattctgaaagtttacaactgtcaatgggtccatacaaattatgtaacatttgaaacaattaacagaaatttaaagggttcttatttaactgaatgtttaaaagttctcttgaaaggaagcaatcttggaagaaattatttaaaacataggataattaaaaatatgtttaataaagaacaataagtaaatgtttcaagatagagtcatgcagttgggaaacaatgatcttttaactagaggtccaaaattcttttaaaaaaataatagattttttattggtatccagggagcaaggttactactgttcttttcttaaacacacaaaaagcaccaattggcaaggtcacctgtttgtatccatgagatcatatacatgaagagtgataaataaaacccaaccaatacttttattaatatacaggaatccccccttacctgcagggcatccaagactcccgagtgaatgcctaaaaccacagatagtaccaagccctacacatagcatgtcttttcctagacatatatccttatggaaaggtttaatttataaatgaggcacagtaagagacaaacaggaataaaattgaacaattatgacaatatgctgtaataaaagttatatgaatgtggtctctctcaaaacatttcattgtactgtactaatctattttctgactgtagctgaccacaggtaactaaaactgaaatgtgaaaccatggataagggaggactactgtatgtgctgtatgtgattcctaatacaaggctatttatttatttaaaacgatttatcattgtgatgtcgtttctgctttttaatacaaggtccttcaaaaattatttgttttgctcagggcaactagttataaggatttaaagcacatgaatgttcaatattaaaaggtaattgaaaaaaaactccaaattgaatctccaaatcttctagtttctcccattgtctgatgtttgaaaacagatgtgttaatgactactacatcatggcttactttcatttttttcttccctagctaggaaaggaattaggagagctcccaataaacatgcctgtatgttgctgcctctacaaacacaagggaggaacaagaacaacaacaacaaaaacctgacaatttccccatagctggcatatacaatttaattaattttggatttgtgaaatttggcataaggtgcctaggaattgctcctggcttacttagaatatgaaaatatgagataagactgccagacctaaacttctccagaagaagggtaaaggctgcacactaaattttctcctaatatgataaaagtgcctccagcctttatctcttctgcccctctgccttttgtcttttggatggtcatggttatagatgttgggaaggcactgagttaaagagaagacacttgggaattagatccctagaaaatggcccttgccttatgccttgtgcaagtcccggaggtgccattcacattgtagtccatatgacctgccagttgcttatggtgatctttctgcttctaaatcctgcttcccaaagtatgagatacacagggcaagcaatacattcaagaacccagcttgctaaatgtctttgcctccaacatcctttcaaatgatcataagtggcataaccttagtgaatttgggtccccatagatacaaaacaaagaccagtggcttttgactcagaagaccaagtttcaatcctgactcgccacatgctagttttgtgctcttggtcatgttacttaaattctcggagttacaatgttctcaccagtaaaacaacaatgacagattcatagagttgctaaagaggattaattaggatagcacaggtaaagttcctggcacacagaaagcacttaatcaatgtgagcctctctgaagtgaaagtaacgcatcctaatactcaggagatttagaccagagagctatactgtccaatatggcagccactagcaatgtgtggctgtcaattaattagcattagactttaaaattcagttcccaggatgctcaatagtcacatgtgatggatgactatatgttggacggcactgatatttaccattgctgtcatacagaaagttttactggacaatagaagaaatgatagaattaaacaagaatccaaagtccagaagccaacatctttgccattaactacgaaactcaagaggagcaactttatctcactttgtcacaatttcctcactggtaaaatggatactgcctttgcagtaatgtggtggggatcaagtacactgcagtcacttttttttttccttgctttagtctttccaagactaaacaatgcatgacatacttactagcaaggatcactttgaggatgagttagttgataggtgcagccctttggtagtttaatattcatagccatgatttggtattattccaatgcacctgtgagcagttaggaacagcatatgttcaaaagtgcaaggagctactgcagacagtccttgtggtgatggaaagacaaaaagtaacaaaactgaattggttttcattggcaagtggccttttgtagactttttgtagctctcacagggtttaaaatggaaagatcaaagatcttatttcctacttttccatttctgtttcactttaatatctaaatcttcctttctcaggtttgaaaacaatactccgttgctgtcattttgggggcaatgttgtatttttttatttatctagagctggggttggcaaaccttttatgtaaagggccaaagaggaaatattttagggtcataaggtttctatcacaactactcagctctgctgtgtagcatgaaagtagccacagacaacatgcacacaaatgggtgtgtctgtgacaataaaacttaatttactaaaataggcccttgggccttagtttgccaactccagatctagaaaaatatgaaagaacatatccttttcacttccccacattgtttccttccccactatgatatatattttctcgcttattttaattttgaacatatagtgtattctacaaatgatcacaatcaaacattcaaatatttactttagtaatgtgaaaaaataatattccttctaatttttatcaaggctttgcacttaaaaaacaatataattcttaatgacattttttttttcctcagagagaaaactgagaggaagagacatgaaaataaaatgtagaagaattgtaatttaattcttggaggaggggataaagcaattaaatcatttatgtgattatttcataaaaggattaataacaagcaaatagccttttattttcaaataagctcaaagccaaaacaatcaaaaacactgattacaactcaagatgagattttgggtggggacacagccaaaccatatcaggtagttaatatgttaaatgtaaacttgtctgagttttttatggcctatatttattgtatagaagaccacaaaaattattgtaaatgaaccggggccagattcaggaataggttactgacctgaaactgatcactggagtcatattcaattttgggaggtgtcttagaattaccaagagaagcttctttccttcctctctccttcctccctctttctttcgtttatttgctcatttattttctctttccctctgctccctctctctttctcttctgaggatgctaaatttgagaacctcacatgtaatggccagcagccattatccacctgtaaaaatggcctgcctgagaataaaacaattagagacaagctacgctaaggatgcaaaaagaacaagctctgatggctttgagcttatttgaaaataaaaggctatttccttgttattaacccttttatgaaataatcacaaaaatgatttaattgctttatcccctcctccaaattgggttgactggaaacatcaatatttacaagtgattcaaacatagtcctcttcagagatcaaaaatttaaaaatgttgtctagttgacataatataggttattttttttactgcaccaactagtgattaagctatcaaaaaccaaaacacaactaagaagacattgttaatattcttcattcattgcatgggcattaagaaaggatgtaagactgatctatccaatagtttatttctccatggcaaacatggctctaaacaataatgactttcatacttttgtccacacataaaatttatgagaacaaagtaagctggtaaaaaaaacaaacaaaatagtttggtctactacatatttatacactgaaaggaaaattaatggtggcaattgagcctcacttaatggaatgagttatactggagtatctccctttgcgttacgcagactgacatcacagttcaacctgtcagacatctgagatacattcctggggttctggtttgtgtataacttttatggattcaataatctcctaacacagaaatgggtatctgataaagttgagtggaactggaataatcctggaatgacccaaattatcaaattttagaggcatacctaagacactaagactagtgtctttgtaaaaaaaaaaaatgtttgaggaataaaattgagtaaaatgagagatacacacagatcttacagcttacaaaacataattttatttaaatttgtatagataaaaatctaccaaaatttaaacaaaaattttatccaaatcctttcccacaacaaaattggacatcatggaaaaaaaaaacacattcaaataaggttcccatctttctaccataaactggtagattctgggaggatgaggagtaagagagaaacgaggagagaagatagtgatactaaacacaatttgatcttcagtgttgtctcatcttgaaatatcttaataacagagatttccataagaatcaggattcatttttgacacaaaaatggaagcttccactcccaaaatcacaaataaggcttctggttttctttttagtgtgaggtaaacagtatattcaatattaaggcaaatggtaaaaacacatggatggtatattaatgcagatattccattattaaatatattttggaatactcacggatttttcaaacatatgttagaattagaaacctgtaaaatctgcagtagtgtgtaatagctatttgcttgaatgtcttagcagtgcctttttagtagctaatatgttcagtgtaatcttatgcctttttagtaattaatatattaaatataatcttgtctgagtttttaaatggtctgtttttctttttcattatgtaggattagatgcccaccaaaattcttgtaaatgaagcaggacttgatttcaaattctgtctatacacacaatatttggccacatagaccactccccaaagtctgcaaaacactgcctactgggcaggcttacagtgacagaaaagtatgagaacacaagatattatttttataaagaccaaaatcagatttaggctgtctagatatcttattccagaaaacacagatttaagatttttcagtgattcttgccttccccctccccttttcttccccaatgagataaccatttctttcacaatgatgaaccatccctttttacggaaaaatggctttctttctccattggatcaggacaaagacatcacttcttggccacactggccacagccttcttggctgcatcctccaggtcaatggctgaagtaatggggagtccgctgttgttgagtatcttctgggcctcttggacgttggttcctagaagggggacagggaacaatcactgaatgaaactagaggtggcgccttatgaagtttgcacaaggacacacaagactcacctgtctacagcttttcactaggaaatgaattaaatataggttctcatcaaggtcactgacagaaaagattatgtgatgaaatttatctcaagctgtggtccagctagaaaagaagatgaaagcaagggcttgcaagagggaaatgaacatattttactgatggaagctgagttgtctgctgataatcacagccatgtggatttaatgcggttttggcccacaccagaagtcacttgtcttaaagccctctcagacgtcatcaggggtttgggctgtgacctgatttgagaaaggaagttccgagaatctgcccagctatgtccacaaatccactgctttggagactctggcgcatccagcatgtccatttctgccttctcctcactctataaaatgaaatgggctgagcccttcaaaacgggcaaagcagcctctgatggcaatctcttgactgttcctggtggatctggagtatcttctggccaagtcacttcattcaaaggtgtgcttggggactatttaacatgagaactgcttttctgccattttagagtgaacaactcctgtaggagaaatgtaatagaatttaagtgtctaatgaaatatctcatcctacatcatttcctgtgcttttatctagttggcaagacagagcctatttataaacaaagaccttgaaatataggccttggagaacttgccttaccacaaagagtgcagataaaaagaggcactgggtcagcacatttcatataaagaggcaaatgctggattaaatagaaatgggtggattgaaaagatgatgcagcactgattcccctgggaccctgggtctacccaagcagcagtgaagatggccgcttggcactgtgtcttcaccttaaggctcacctactcctgtttttacagaggaagctggtgaaagtcctctctggaaggtgaaagcataaaatgtgggaagctgctacctaaaatctccatgctggctctgccatgtacttgttatgtagttttgggtaaatcgtttaacttctttgagccttaacttttgtttccatacagagcactatcatcctcgtaatcttcccaagaactaatatcattaagtgcttatgtatgccaggcacagtgctaagtaacttatacacagcatatgaaatctttacaaaaactatgagtagtcctattgttcctattttacagataaggcaactgaggcacagagaagttaaataacttttccatggtcacagaggcggtaagtgtcagagatgggacttgaactgttctctgtaattataaacgctgcatgttctaaagatatgctagtctgcttacctacttgaaaaatgaggacagtatagctgatggtatagattgtgatgagaagcaaatgaaatgagtgtaaaagcatttttgtaaatggtgcagtatctgtggcaggcctggctggctttgcaccacagactcctgctcctcttctgcagtagagtgctattgctggaaagcagctgcccagccagaaactacatttcccaggcccccctgcatctcgaaggggacatgtgactgagttcaggccaaaggaatgtcacatggccatgacaatctccaaagggactcttcacactcggttttccttgtctgctttctggagtgttcctagctggggcagccctggaagtcacctttttggttctggttgtgttttgtcttgctttttgtttttgagataggctctcgctgtgtcacccaagatggagtgcagtggtgtgatctcagctcactgcagcctcagcctccggtgcccaagtgatccttctacctcagcctcccaagtagctgagactaaaggcacacatcaccacgcccagctattttttgtattttttgtagagatggggtttttccacattgcccaggctggtcctgaactcctaaactcaaggactccatctgccgtggcctcccaaaatgctgggattacaggcatgagcccttgcacccagccaaatcacttcttgaagatggcaatgactccttcagcctggatactttaataactctctggagccaagcatcttacccactcaccctcttagaccttatgggaatgagaaagacccttctataatgttaagactctgaaatttctgcatttttctgttgttacaggagctagcattattttgactaacatatgactttgtaaatgctgtggaaggcagcttctaaaatggttttcaaagatcaatcactcttgcctcctggtagtcacatctttgtagaatccgtcccccttgagtatgatctggacccacagccttacttctaatagataagaacatggcaaaagtgatggagtgtcacttctgagactaggttacaaaagcctgtggcttcagtcttgctccctttaactcttttttcactctgatgaagcaaactaccctgctatgagctgccctctggagagactcacctgggcaaggaactgagggcaaactctggccaacggctgatgaggaactgaggctctgggtctaatagccaaggaggaagtgcatctggccaagaaccatataagggatcttggaagcaaattcttccctagtcaagccttgagatcactacagctcggctgacactgtgattgcagccttgtgagagaccctgagtgagaggatccacctaagccacacccagattcctgaccacagaaactgtgagataataactgttctttttgttaagctgctacattttggggtaatttgttaagtgctgataggtaagtaacacagatgtaaaaatgtattatttcattaacacaacctgcgtgcactttgattcatttgactgtggcaggtgttagatagcaggctaaggaatttagaaactaatcaaagcatggctttcatggagtaatgacagagtgtgaaacaaaagccctgatggacacaggagcaaaccagtctttggaccagaaggtaaatgacagttacacgtgtaaattttgttttagacagagtcttgctctgtcacccaggctggagtgcagtggcgtgatctcagctcactgcaaccttcacctccctggttcaagcaattctcctgcctcagcctcctgagtagctgggatgagaggcagtggccacctctcccaaccaatttttgtatttttagtagagatagggtctcaccatgttggccaggctgatcttaacctcctgacctcaagtgatccacttgcctcggcctcccaaagtctgggattagaagcatgagccaccgtaccccatgtgtaaatttctatctcctcctgcagagacgtagactaggcccttcttcctcttcctttcttcttttgagcaccttccaatctcaatgcagctctaagacctccagataggtgcaggagtggcgctcctgatgtcttcctccatttcagatcctgctctttctggagactagttttttatcacggttcccacttattcagataacttcttattcagttttacctgagttcctttgcatgtgtatggatgaaatgagctcttgatcttcttaattttttgagataactttaatgagttgtgcttccttgcaaccaagtaatctaaataatttagttccttaattaatatcctcttttgcacccaacttagcaccagtattcccaagggaaaagaaatgatttagaaattcatgagcacaaagatgtgctgggccactgcccttgctgggctttccacccagagctctgttgggctgacacctctctccactgggctgacacccattcattcacaaggcatctgttaaatggtatttctttggggatatctttctaatcaccacctccccatgccccaactaaagcaggggctggtacaatgaacttctggagcaccttgtatttctaaaatcttaccatggatgaagtcttattgggatgacttactgatgcttccctcgtcccctctaaacatccactttcctttgtcagacttgcttactggatacctcccaatatccgttagctagcagtacgtgctgaccgacggggtaactccagatggattcccacatacaaagtgtgcttgacgagaagaggagtgggcgggtactttttgatagatctccttgctgtcctaacaaccctttcctatagggttgaaatagataccgcaaactgctcaaggtgcaatcaggagggattttttttttttttttggagtcctctcacagttacctaggggttttgggagtggctccttttgctgggaagggcccaggaagagctggctgtgctcactgccctgagtgaggactccaagctgttaccacttctcccaacctgtagcagcttcaagtgccccagtcaagtgaggccttgctccaggctaacactggtggacagggccagggaagaaaggggacggagcagtttcccagaaaaccacaacccttctctcctcccagctgctccttcagtgccatgtgaaaatgcctaattgcttcataattctaggatccacaaaagtgaattttaattatacttgcagttacactttaattaccaccttaattattaagcatatactaggcatgctcagaactaagcagtttttgaagggattctcatattcaaatatgaagctcatctgttatgagaaatgggtcatatgcagagccatcatgaccaggtagaaacttgttacagaaggggaaaggggggtagagagagagagagggagatagagagagagacaaatgaagagagagacaagagacagagtcatggggaatagctcaaaaaggaacagacataagaaaaaagacaggtagagaataagagaaagtaaaggaaaaaaatgagtttgccaagtgccttccacaccagcccctaccctgatgctggcaccatctctttgcagcattcaacctggtttctccttgaaggcatagctctactgcccactgaccctgcccttgtcgttaactaccacttgcttcctccttcctgttgagggaacaactggaaggggaggtggggacacgcagagaagagggattaaaaggaaaccagctgggcatggtggcctgtagtcccagctactcaggaggctgaggtcagaggaccgcttgagcacagaaggtcaaggctgcagtgagctgtgattgcaccactgcactccagcctgggcaacagagtgagacccacttctattttcaaaataaataaataaataaataaaataaaataaaataaaataaaagtaaaacagcagagagtggaaacaggttattgaaaaagaaaaggaagaaaagaattagaggaagccttggaaatgactgtgagtttctgcattccttttttgcaaaatgatattatttgagtatttaaggttattttcttcttaattcaccaagtgtctgacatctattccccaaccctctccctgcctttacttctaaatagaaattatcatagctgctttaaactctgacatggaattaagtgttctaaagagtgtttatgcctgtgcacagaattacaaaggaaattgatctccttcccacatttaaatggtgctactgacatgttctaatatttattaaatgctacattgctttttaatgagccttcaggacaacacttttaataaccacctgtacagataactgatcaactcatgctggtggaacctcaggcacttcttaatatctgcttgttgagagccactcagctaaatggttatctacccactgcaggccttaaaaatggaaaatcaaaggggaatgagtttaaaatgaaatcttgctctactactaggggatattataaataataacaattattaaaatgttaaaaattcgtgacctccttggcatgttaccagtgactttctgccactgggtggagtaagagagctgtaaacaaagatgcaaggttaatttatcaaaatttcttcttcgcttttattacacacaagagaaaataaaggtagtgggcacatggtacaggattttgttcgcaaggtgcagacgcctcctgccttttatcataaggctgtgaagaaaatcattttccagtctggaaatatgtagaaactgtaatttaaaagttattattttaataggaattcagttttttaaaaaagaatacagtagttagcacttattgagtacatattaggtgcaacaaatgtttgttggatacatgagttaagggatttacaagtatcatgaaacttaatcctcagagcaaccctgcagtcaacatcattttaatccccattttacaggagaggcaacaaaaacactgggaggcttcggaactggcccgacatccccagcaagtcagaggctgagccaggacttgaacccaggttcacctgagggtaaagccacataaccacgcagctggcctttaagtgctagaaggaattcactagaggaaaatgaggcccagagatgtcagacaatttgcttggatcaaacaaccagttaaccctgacaggtctgattcttggtctagtgctctgagtcagggctggcaagttctagtttttgggcaaaattgagccagctgcctctttttgtatcacctgcaagttaagaatagggtttacattttcaaatagctgggaggaaaaaatcacaggaacattttatgatacatgaaagttacatgaaattcaaattccagcatccataaataactttttcgtggaacatagccaaactgatttgcttcatcagtggctgtttgcgctttgcaatgggaggagtcagtcgctgtggcacagacagcatggcctcgaaagcctaaagtatttcagcccctctgctggaagtaactgagtttttttctccccactgggagaggggaattcagtggaaacaagccaaattctctaaagcagcaaattcctcctcaaatgtccactgctcctgtacccttgcacctccttccttagtctcctttcaagtggcaattagatagaggaggtccattttcttggtgacctgtaaatttagataacttttcatgtctcttttgccttgttactttatgtcagaaacagaataattcattgagaatcagaggcaaaacttctgctatgtcagcagctcttatttctttgagatgatatgtgcctaatacctagcaccgtgcttggcagccaacagcattggccatccatgtggcctcagtcgagatactgacaagggtttagataataataaggatagctaacatttactgagccaaggactattgcaaattatttaaaaactcatctgctccttacagcaaccttatagagttgccctatttttattccattttgcagaggaagaagctgagattttaaacccggttctgttcccaagtagctgaacaacctggggaagttactgcagctttgaggctttagatttctccttgaatgtgaatcatatctaaatgctttgtacccctaacattttatgaagattaaagatgacataagatattctgtgtggctgtattgtatccacacctaatctcctcgatgatttcttctcgcacagtaagaagaaatcaacactcgaggtgtgaatgtgatagttattcggaccatcacagcaggagcccccagctccagtggcaggaagccaatggctaagttcttctctacacggtttcaaagaatggtgtgtatgtgctatgatcatgcaagcaaggtttaggatcaagtctaacatattcactgagagctgatgctacgtgcttatgctttcaattacgttaacccttgaaaaaaagcaacatagatactaaaccaaagttaaaggagccttaatattaaacaagaatggaatgaaccctctggcaagcaagaacaccttacacttctgtgctcacctgccatcatctgctagggataagacaattcttttaaagaagggatgttttatacacccaaacatctgcatgtgaatttacctttcatgctttccttgaatcttcctcctagctttcaagccatgcatactctaatttacggatgatttaagaaattttcaaaggtaattttaacagtgtgagacttttgtcgaaaatgctgactttggtccaccattactgcctaggacagaatcacattcatcactgtgtcactcagtgtgattctgtccttacgtggggaaatgactgagtggacctcattgctaatattttccttgggaagaagtcagattctcagagcttaatattgcctgccaaattcttacttgactctcacgagacatttcagagcttaggggaagggagatttagatagagataacgtgaggattttccagaattctaggtcttgctgctggcctcttttctacactagggatctgcaagctatagctcacggaccaaatctgttccactatctgtttttgttaaaaaaagattactgtgacacagccatgtccattcctctacctattgtctactgctgcttcaacactacaatggcagagctgagtaatcacaacagggaatatacagacacaaagcctaaaatcctgccctttacagaaaaagtttgtagacctttgctctatacaatccaaatttctggccttgtggctaaagggtcaggtgaagacaagaatcatcttcatctggtgtttcccagcttgcagtccctacttctgacttgatatagtggtaagcagctatatatctaggagaaaaaaacccacctatggtctctttgaattgacaatggcaaatattggctcgaatttccactccctccaccccttcccacatgtgtggctggaaagatcatagaactctttttccactgagctgggatatagcctcagaatctttcttggcacagcactgctcaggcagccactgccaataaagagaaggtggcatgagatgaaagctgtcttccctcatctgaaacatttctcatgaagtctttccccataggtagttctgcctcaggacagcctcaaggtggcgctctctggaagagtctcagcgggacacacttagcgtctataagacactacagactgaatcacctgtaagtctcgtcctgatagcaatgtgctcgctcgctctttttgatggctcatcaaatatgactttcaagtggaaattgagtcaggaagaaatgaactgactagtcactcagaagatacccgagagcacgcagtggtgttctgacactataaggcagcacttaggatatgcgagtcctggtacctgcccagttttaaaacctctccttataaaaatggccacacccacagctgctgctcagggaagcaacttcaggctcttgttcctgaagggatgaccactgcctagagtggggcagctacccgaccaaaggcagcccactcctggggcagataagacctgtgatgtgcactgggggatgtttccttccatgcagagggacagtcattagtgtaacccctcctgttctctttgcctatcactggctccatccgggagtggtgatggtgtagggagctgactgaatatttgaatggagaaagttggcatgggtagtcccgccccttcctctggccttccttttagggatatgccactcagagtgagtccaggtcatcctctgctccttgggttccaccctgggatggaaggtacactgaagtctagtggagcctgtgactgggtttacaaagctgcctaattctggggcttagagtaaggaagctcactggtggtcacacaataaggtgcatcctccaactacttcttttttctttggtgatgaaggtaatacttttgtttcctcagtctattttatttcttactgggatcagaacccaggtggaaaaggatctgttgggcctcttcaaagaccctaaccccaaggcttggctggatgggctgtgaacaatgggagcagtggctattaggtaagctaattaggttggctacctatgggatctggacttttaaggaacaccgtgggatcaggatggccttcctgagaggctagaaggtctcagagggaccaagaaaaaacacaaaggagtgagaaagtcagttctgtggaccatactctgagaatcaccatagtaacagcagtaacagacactttatttatttatttatttgagacggagtctcgctctgtcacccagactggagtgcagtggcgcgatctcggctcactgcaagctccgcctcccaggttcacgccattctcctgcctcagcctcccaagtagttgggactacaggcgcccgccaccacgcccggctaatttttttttttttttgtatttttagtagagacggggtttcaccgtgttagccaggatggtctcgatctccgacctcattatccacctgaataacagacactttaatatgataactatccaaaagtcttgtacacttcatcaacaaactcagattactatactcaagcagccccactgagtcaacatctactgtattagtctgttctcacgccgctaataaagacatatccaacactgggtaattgataaaggaaaggggtttaattgactcaaagttccacatggctgaggaggcctcacaatcgtggtggaagagcaagggacgtcttacatggtggcaggcaagaaagggcatgtgtaggggaattcccctttgtaaaactaccagatcttgtgaggcttattcactatcaggagaacagcatgggaaaaacccaccaccatgattcaattatcttccacagggtgctgcccacaacacgtggggattattacaattcaagatgagatttgggtggggacacagaggcaagccatatcatttacagtatcattcttggaacagctcagttttcccaagctctgtgttgcagccataattccctggagaccttctcaagaaaaagtccaaggatattttgactctgctggtgtacccccatcctttgacatgaagactcccaaacagttgtagcctgtgttgttctctgtgcttgcctctctctttgtatctctttcttcttccactctctgccactctcctttctctttccttccctgagactgtctgcctcacatgtttagatctgcacaatatggacttaatagaaataataatcacaaaggaaaaatgaaaatggcagacacgccagtcagcaaagcctaatatgaacattaaaacatactgatgaattaaatcttcttagaagtgtaaatgcagcataattgatcccaataaaagtaataaaaggaaaataagtgacaaagctacaatgaaaaaaaattgatcaaggagtcaatgagtgcatcagtattggtgtatttctgattaaaatgttgatgtcagactgttttcagggtcaaagtgatcagagaccctcagattttaagagtcaactcttctcctgttcttaaagggggaaaggtctctatcagccaattatattattgtttgtcactggaaataactagaaatgaatgcacactacgattgacccattctttctggggatcctttctgtgcctgagttgtcacagaggcccacaatttattagttattcatacatttcgagaaaagctagttaccctgccttaaatttttcccaaaagatttaaaggagtgcatcttttattttcatactctgcttagtattccagaagaattaagtgatttttataatacgcagatgatattcatgctgaaatatgcaaaataccacattcaagattattttccttaatattctctgctgattgcatcagaggtctatctgagatactaagaagaagatttgacatttctaaatttgttagatgatcagatttgaatcttttaactaaatgtacttccaaggtttatgcctgtggttttttaattagttaattagtatattagtaaataccatgtgcatgcaggtcaatgaactttaggcattaaggaggatcaagagagatgtaaaaaaaaatgtcagctactagatggctgggaaaataaaatggaaaaaactaacaacataagacaatatctataaaatggtaacaagtgttatctgctaataggacctgcttctatcttagtaaaagtagccatcaggggatcccagacagccaccagactggtttgctgaatcttcagaaatattgataacttcacaatgtccactgtatcatgaaggaattgaatgtgatagctcaggatgagatcaaagagggcactgccttccaaatttatgcaaagaaaaatatacatagtgacccttcttagccactaccctctttccactattatagctcctctcttaccgtaagaatctgggatctttatcaagagagaaaaagcaagagagctttggacatttctggagtcctagctggtgtccttttcttcctcttgtgggaattggcatcttgtgtgataaacgtcctcggatagatacagggtctcacactcaacatgaaactaccagggatactcactaatattcatatgtgtgatttctgtgaatggagcagacccatagcaagacaagacctatcccaacattgtattgaccatgcctaataaagggaagatgaagcattctgttataactgtattcttggcactgatcataggtgaaacaatgcagaaatttgaagaaggtattatccataaagggaactaaatgcaaatcaagccaatgctttttagactaaggaaatgcagactcctaataatgtgtccctttaagggacaaaagtcagtgcctagtgtagctctgctcactttcattggcataacccacttttatgcttattcaacatggactattatagttatagtagatttagagatgtgagttagcaaagaagtagtataaaaggagaatttccaagttgagtctggaggataggtaagaattgaatcattgcaaaggaagaaggaaggagtgggtagaggatcagaagtcagtcatcaagtaagtcatcatccatacctgagagttggtattggggtcgtaacagaggtaaaaactgaagcccaggacctgggtagatcagaaggatgtcctggagagagtaatggctttgcagcaatatgttacggctaaaagaacagagtgggaaaactgagtaggtaccgagtcaatgacattaggcagaaccaaaaacccaagcagaattgccacagatataaagtggtatggaggcaagagcagagagaaaaggagatgagacaacaaggggaatctaaggaatttaaatctgtgaaccagaagaatgatggcatagttgatggacttgggaaagtcagaaagggaactcaatagagagcgtgggagaggatcagagatgaagctgcaacactggagagagtgcatgtggagaaagatgtatgaatacagggggccatccaaggagagatgtgacagacaaatggagaagttatggtcattttaaaggcccttcataaaccacatgcagaactgtggttttcaaagatagctcagtgaaaatgaaaaaccaaccaaaaccaaaaatatcttgtcacaaatagtggttctcagtacttccagtggagaaaaagttgccaactacagggacctttgcgaaatgtcttttatcttccatctaaatttttcatttgctttcctctatgtcaaaacataaattcttattctctcacaattttctctacatttagttgtagtttatccaaccttagagtatgatttggttccttctgttttttttttctaaacagagcaagtcttcatttgtctacaagaacaaagaaagataaagtggtacaaagagatggaaacattttggacgcttttagtggtagtttctatttgacctgacattacactatactctgttttgatggatgaatttctcaaggttctttattcatatcaatattaaaattggctcagactcccacaacacacaccattgtctagctagggagagtgaggtgaaaacgggtctccatcatcccagtagctattacaaagccaagtgacactaaaaatgagatgtgatggaaaaatgttaccagagactggattacaatggtacataatttttattgctaatatttattaagtactttctaagtttcaggcacgctgccacatgtttatcacagtctgaagaactgtgagattttcagtgatccagataacagacatttcaaaacccagtggcacattttgtaactactacctatttcctgtgaataaagtaagtggccttcttgtttgtttggtgaccattcagaagatccagggtccttgccatcagtctctctaatatgcagcccacattttaaagattctgttgcccacccacaatgtattaaaaatatcctgatgagaaaagttttaatcaatcaaatcaggcttgatgtagtgggattttgtggacaaatctttgttctcagctgtataataattacaagctgtttcaccagtggataaggaaaggattattctcctctttgaaaatggtaactttataattacatgtatttacttgccttatcagaacagaactcaccaactgagacagaggattatttttgttcaaaagactcttgcgtgaaatgaacagctacatatttgggggaaattcagcctttgtaaccaattgtttctggtgtgaataaagaacaaattatctgaaatgagggttttttttttttcctttttgaaacgtataaaaaccttggcacaaaaattgcctagacggttaacttggcccaacccatgaaactgttgagaaatgtacatttattgacagctctatacagtcagtgtacaaagcgttttggccaaacgcagtaaacaaaatgttttgagtggttttacagttctttatcagaatccaccaacatcttataataattttttaagaattccttttattactgtcctatttaaatctgcagcaaacttctatgtctcagatatgtctgaagaggaatatgcttgtttctcaggtgttcattatgactccaagttgagctcttaatatattaataataaacctcgagataatttgtagactggataccgtttctcttagccaaatcttctcaattttattttccacccaataccaaaaggtttgtttcagcaacataaacattttgtttttcttttgccaaatgtctttaaaaacaattatcccacccccttcattcttacaaatctctctaacattccctaaactttctctaaagttgttgtgaacataaacatattctgtgtctttcgctttcttgactaggcactgtacctcctctgggtggacactttcttatccttgattctgaaatactgataaactggagccacaaatagaagagtacaaatcgtgtccttcttagcatggactcggtatgctaagaaggacacaatttgcactcctattcgctacatgatggtatgtgatcctttggtctgctggaggagagaaagaaacctttgggtattaaagagtttagaggcagccatagagttttcagctgtgtcccatatgcttcgtggctattcattcttcaagtcttcagttatgctaggttctaagaccaagagatgagagcagtaataatgcctttacctcctatcaaaaaggcagcctcggtagattgactgtgggccgagtagctttgaaaacattttcattcagaatattagagcccaagatttgctgctaacacccagaatacattgagaacgggcccttagctgagtggtggaattgttctgggcagagtgaatgcagatccccagcagagccaaggtccagttctgtgtctgatgatgtcccctggcctctttgcacttttctggatttaggcattctctccgctgctcgtttccaacgtgtgttctgtacggagttaattttccatcttctattctttactcaagccctgtccccttgcaaggtaagatggacctgtttcccacctccacccacagcctgtctgaggtcgttctgttgctgctgtcattggagacgtggctcttggaggagggtctgatgtttttgtcagtgcatgcccctgtccttctgtatgtttgagtctcattgtcctttctcttcttactctccaggtctccattttctacatgtcctgttcatcactttgctctctgcctcaccagtgcccactcacctcttcatctccttcctccttcactgacccctgtggacatgtccttactaggaccagtttcacttcacagtgacatctttcacctctcctgccttatcactcgcatcctctccaccttttccctgcagaacccccttgctccttcctcctggtgttcaattcttcatcatcagcttaaacccagtaagacattgagggaatcccatgctgccgtcaagcctcaaatctgctccattgtctaaaaaacacttcttaatgcttaaactttaccacacgtaaacattagacaaaggctcacaggacctgatcaaagtattagttaggctagctttcttagatcgaatatatcaatttccaggtaaataatctactatatttggccctttgggttttcattttacccctaggataatgtgagtaattgaaatttatcccatgttagacatccactgccttaccttagagaaaacgtcctaatacactttaggcaggggcagaggggtgctccttaaggtaaaaaccactttcatagttaatagtggcagtaataataacaataagagaagactatgttggcatttgtactcataggttgaaagtaatggtaggcaaaaccgctggcatgttatcatggaatcaaggcagtggcaccatactgtgctagtagtcactgtacttttttttttgagatggggtcttgctaagttgcccagactggagaatattgtcatgatcatagcttgctgcagccttgaactcctgggctcaaacaatcctcctgcctcagtctcctgctcagctgggactagaggcatgcatcactacacctgagagatcactgtactttttactaccacatactcacagtaagaaaaaaaaaattggggaaggcagccaagatggccgaaatggaacagctccggtctacagctcccagcgtgagcgacgcagaagacgggtgatttctgcatttccatctgaggtaccgggttcatctcactagggagtgccagacagtgggcgcaggacagtgcgtgcagcgcaccatgcacgagccaaagcagggcgaggcattgcctcactcgggaagtgcaaggggtcagggagttccctttcctagtcaaagaaaggggtgacagatggcacctggaaaatcgggtcactcccacccgaatactgcgcttttccgacgggcttaaaaaacggcgcaccaggagattatatcccgcacatggctcagagggtcctacgcccacggagtctcactgattgctagcacagcagtctgagatcaaactgcaaggcggcagcgaggctgggggaggggtgcctgccatggcccaggcttgcttacgtaaacaaagcagccaggaagctcgaactgggtggaacccaccacagctcaaggaggcctgcctgcctctgtaggctccacctttgggggcagggcacagacaaacaaaaagacagcagtaacctctgcagactttaatgtccctgtctgacagctttgaagagagcagtggttctcctggcacgcagctggagatctgagaacgggcagactgcctcctcaagtgggtccctgacccctgacccctgagcagcctaactgcgaggcaccccagcaggggcagactgacacctcacatggccgggtactcctctgagacaaaacttccagaggaacgatcagacagcagcattcgcggttcatgaaaacccactgttctgcagccaccgccactgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagacaaaaagtagataaaaccacaaagatggggaaaaaacagagcagaaaaactggaaactctaaaaagcagagcacctctcctcctccaaaggaatgcagttcctcaccagcaacagaacaaagctggacggagaatgactttgacgagttgagagaagaaggattcagatgatcaaactactccgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacttgaagaatgcagaagcctcaggagccgatgcgatcaactggaagaaagggtatcagtgatggaagatgaaatgaatgaaatgaagcgagaagggaagtttagagaaaaaagaataaaaagaaatgaacaaagcctccaagaaatatgggactatgtgaaaagatcaaatctacgtctcattggtgtacctgaaagtgacggggagaatggaactaagttggaaaacactctgcaggatattatccaagagaacttccccaatctagcaaggcaggacaacattcagattcaggaaatacagagaatgcctcaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccacccaaactaaactgcataagtgaaggagaaatgaaatactttacagacaagcaaatgctgagagattttgtcaccaccaggcctgccctaaaagatctcctgaaggaagcactaaacatggaaaggaacaaccggtaccagccgcggcaaaatcatgccaaaatgtaaagaccatcgagactaggaagaaactgcatcaactaacgagcaaaataaccagctaacatcataatgacaggatcaaattcacacataacaatattaacttgaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacagaaaaaggcaggggttgcaatcctagtctctgataaaacagactttaaaccaacaaagaccaaaacagacaaagaaggccattacataatggtaaagggatcaattcaacaagaagaactaactatcctaaatatatatgcacccaatacaggagcacccagattcataaagcaagtcctgagggacctacaaagagacttactcccacacaataataatgggagactttaacacctcactgtcaacattagacagatcaatgagacagaaagttaacaacgatacccaggaattgaactcagctctgcaccaagtggacctaatagacatctacagaactctccaccccaaatcaacagaatatacatttttttcagcaccacaccacacctattccaaaattgaacacatagttggaagtaaagctctcctcagctaaagtaaaagaacagaaattataacaaactgtctctcagaccacagtgcaatcaaactagaactcaggattaagaaactcactcaaaaccgctcaactacatggaaactgaacaacctgcccctgaatgactactgggtacataagtaaatgaaggcagaaataaagatgttttttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaaacaagagcaaacacattcaaaagctagcagaaggcaggaaataactaaaatcagagcagaactgaaggaaatagagacacaaaaaacccttcaaaaaatgaatgaaaccaggagctggttttttgaaaggatcaacaaaattgatagactgctagcaagactaataaagaagaaaagagagaggaatcaaatagacgcaataaaaaatgataagggggatatcaccaccgatcccacagaaatacaaactaccatcagagaatactacaaacacctctacgcaaataaactagaaaatctagaagaaatggataaattccttgacacatacaccctcccaagactaaaccaggaagaagttgaatctctgaatagaccaataacaggctctgaaattgtggcaataatcaatagcttaccaaccataaagagtccaggaccagatggattcacagccgaattctaccagaggtacaaggaggaactggtaccattccttctgaaactactctaatcaatagaaaaagagggaatcctccctaactcattttatgaggccagcatcatcctgataccaaagcctggcagagacacaaccaaaaaagagaattttagaccaacgttcttgatgaacatcgatgcaaaaatcctcaataaaatactggcaaaccgaatctagcagcatatcaaaaagcttatccaccatgatcaagtggtcttcatcactgggatgcaaggctggttcaatatacgaaaataaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatgaagggtattcaattaggaaaagaggaagcccaactgtccttgtttgcagatgacatgactgtatatctagaaaaccccatcgtctcagcccaaaatctccttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaaagggcgtgaaggacctcttcaaggagaactacaaaccactgctcaatgaaataaaagatgatataaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagccagcattgccaagttaaccctaagtaaaaagaacaaagctggaggcatcacgctacctcagttgaaactatactacaaggctacagtaaccaaaacagcatggtactggtaccaaaacagagatatagatcaatgcaacagaacagagccctcagaaataacaccgcatatctacaactatctgatctttgactaacctgacaaaaagaagcaatggggaaaggattccctatttaataaatggtgctgggaaaactggctagccatatgtagaaagctaaaactggatcccttccttacaccttatacaaaaattaattcaagatggattaaagacttaaatgttagaactaaaaccataaaaaccctagaagaaaacctcggcattaccattcaggacataggcatggacaaggacttcatgtgtaaaacaccaaaagcaatggcaacaaaagccaaaattgacaaatgggatctaattaaactaaagagcttctgcgcagcaaaagaaactaccatcagagtgaacaggcaatctacaaaatgggagaaaattttcgcaacctactcatctgacaaagggctaatatccagaatctacaatgaactcaaacaaatttacaagaaaaaaacaaacaaccccatcaaaaagtgggtaaaggacatgaacagacacttctcaaaagaagacatttatgaagccaaaagacacatgaaaaaatgctcatcatcactggccatcagagaaatgcaaatcaaaaccacaatgagataccatctcacaccagtgagaatggcaatcattaaaaagtcaggaaacaacaggtgctggagaggatgtggagaaataggaacacttttacactgttggtgggactgtaaactagttcaaccattgtggaagtcagtatggcgattcctcagggatctagaactagaaataccatttgacccagcaatcccattactgggtatatacccaaaggactataaatcatgctgctataaggacacatgcacacatatgtttattgcagcactattcatgatagcaaagccttggaaccaacccaaatgtccaacgatgatagactggattaagaaaatgtggctcatatacaccatggaatactatgcagtcataaaaaatgatgagttcatgtcctttgtagggacatggatgaaactggaaatcgtcattctcagtaaactatcgcaaggacaaaaaaccaaacaccacatgttgtcactcataggtgggaattgaacaatcagaacacatggacacaggaaggggaacatcacactctggggactgttgtggggtggggggaggggggaaggatagcattaggagatatacctaatgctaaatgacgagttaatcggtgcagcacaccagcatggcacatgtatacataggtaactaacctgcacattgtgcacatgtaccctaaaacttaaagtataataataataaaataaaaaaaaagaaaaaaaattatttcattaaacctcaacccttgattacacatctgtttgatactctttgtgaccaaattataaacacacataaagcacttctgcagcatcttgaactgttctgaggaaaagtgttcgtgcaactgtctgggtatcaagctaaactgctcacttttccatgaaatgctgtttctttcttggaataaagactgacacactatagttgctcagacttggttagctggcagacattttcttaaatatgagtgaagtgagtctgtcccatcaaggaaaacaacttaaccattttgtggctgataaaatttgcactataaagtcaaattcaaattctagacaatgtgcacctgccctgtgaacttgacagcttcctactaaaaagcttttctaatatgatggtggtaatattaacaaatgtgattttttttatattgtacattgaaatgagacaacctttggaagatctgcataatcacaaattttctggatcatcagtgaatgattttgaaccatgcatggataaaactcccttaatgtgtaacacagaccaatgggttttaatggaatatgaaaagttcatcgagatagttccagattccacatggaaactaattttcaataaactattaccaatagacttttagtgtagtaccaaagaatattcagaactatatgaaaagagcattaaaaactccccctggctaggtgtggtagcttaagcctataatcccaacattttgggaggctgaggcaggaggatcacttgaagccaggagttcaagaccagcctgggcaacaaacaaaccctgtctcaaaacaaacaaactaacaaacaaacaaacggacaaaactactcccattttgaaaaacacatatgtctgtgaggccagattttcttcatatacttcaactaaaacatgttataacattttatgcagaaacagacatgctaaatgtgaaaagttatttacaaacctgtaaaacaatgtcattattcttactaaaaattttttaaaatatttattgctataaaatatataatacatatgatatataaaatataccataaaatatacaaattattttttaagagttattttttaaattccaagtaatttcagttatcaaattaatttatcaattaaatcaattaataaacattgacaaatataagccaaaaaaccaaagctttttgggatcctcagttatgatgcatgattctcagagaaacatttctcagagtgtttttccccaaacactaatctcataaaatgattcataaataaaagggcttttgctctggggtaatttttcaaaatctggagaatcataacacctgccatacttggagagctaaaagccacattagtttgctagaggcccagggaagtcctgccgtactgtgtttgtttcatcttacacaatctagtgtttcgttctgttatctcaggaagtttgtgaatccagaacatgctggtcacctgaccttggagaaggggtgctggcacagcggaaatctaccatgactcaccttcaagccggaccaccaggggcaccttgagttctagctcccggcaggctttggtgatcccattggcaatgatggcacagttgacgataccaccaaatatattgacaaggatggcttcaacctgaaatcaaaaataaaaagttaccaatcaaaatgctgatcgccaacagtctcaaaaataactggttaaataatagagacaattaaaataagactgctcgtttttttgtttttgttttatacagagcataaaatacaaaaatggcccagaacatgttaagaaagctcatattagtaataaattaataaatatcacaatataacattaccaaattttcccatcaatcactcttttcaactcaaaatgaatttaatcatcattcattcgtctattatataatgtcttctttttctgaaaatattattgtctattctttttatgagtagtatcatttaaaatttcttgcatttaggtttttttcctccacgatttacaattgcctttttatatgtcatggtgcctcacacaatatttcaaaatcagaaaccatttattgttttgtattaaaaggtaaaaaagattcaaatgttttcatgcttccttaatacctctttgatatgctagaggtatgttctcaaaaatcagagatagtttaattatcttagacagcaaccttttgattaaaaaaagactctcgaaataaagagatccaagcttatagcataagtaagaatgtaaggaaagtcaagctactgactggagcttcttagaaatgtaaatttaaacccatcacccatcatgttaacttgtttgtacatattccatattcaaaggcatgtgggccaaaaaaaaaaaaaaaacaaactctacttgtcctgacttgataactaggcataagaaaatcctgtataattaacatgaagaacgagataatgaagagaattcattacctagattaattgataacacccacagaaaaatggctgttcatgaagctggaggcatcaaaattccaacagtagagtcacaattaaattatgccacactaattgtaaagcatatatatatgtgctgcatagaatcctattatttctgtctgttaaattacctacaccaaacatatgagaagagaatatcttacatttgtatagcatttaaatgtttagaaagtgccatcacacaaatccttattttttattgtgagccttcccagaaccctatttattaggtagggtgaaggttggctctctagctgagaaagccatcgggcgcattggggcatgttgtcccaaggtcacacagctgtcatgtggctgtggccaggcccaaagccagctccctagattgtctactgatttgttcattgatgttgttgctagggctgggaccttggtcgagttacagaacctctcttgaacatttcctcatctgtattatgggaataaaaagaggacctagcccacaggatgttgaaaggcctaaatgaggtaatacatgtgaaatgtttaccacatggctttaaatgtacttaatgggtatttacacttgcatttattcagcaagcattgatgaaagtgggcaagtaagaaaacctttttcagtagactgcagctcatgttgaattcaaatataatggaaatacaaacttattgaaattcaacaaaaaggtaatgccttaagaatcaaagaaatgaacaatatttttcaaaccaattagagattggggctactcccagaaaagaaatctcccattactattcacagtaggacaactggtaagcagaagcttgctttctaatgacagctattaaatgctgttagcattgaggcttggtacagcagtagtttccaaataactgtaggatggagaggaacttgccagaacaatagaagaaaaacattcaagagcaagaatgactccatggggtccatgatagaaactcaggacctgctgaggctcagtaaggtttgtgcagaggaacttggcattctagtaaaacacacattggcacctgcatgcctctgccatgttccagtctgcatattccttaaggacaagttcggatgtcaacttctcagggaattctcattaaattagaatcactgactctgtttaacccatctaaagctttacgatcattttacagagtatagtttacatcataatcttatgtgaattcacctaaacaggcaggagtgagggataggagcaaaaaggagagaaggggcttgagaccctgtgattcaattctacttagtgggtgagtgcctggagtaagtgtcaaacaggaatcagtgttgcctcaggtggcatcagttcccatgagtctctcatgtgttagtatctcgtgtttaattagagtccgatgttaaaaatagatactcttcatataaccacttgcggttaaaatttaactactttagttggtgctgaaccccaggaaaagccttcttttctaactgcagagggataactggttttgttagacttactgagaaatgaatagctgttgttctccaatgtactttattctcctcttaccttcctctccccatcccaagatgcaactcccgtgtttggatcatctttgtgcttctctaaaacaaagattatgtattttcccatttttttaataatcagtagccagcacaatccatgatatggcataatcacgtaaaaataatggtttaacaatgaatgaattaatttcaacagacacttgatcaacatctcccttgtaccaggtacagaattaagttttgggatatggagaaggatgaagtatcatcactgtcctcagggaagaattcaaagactagtttgagagccagaccaataaactgacaattacaaatacagggtctacagatgtctcacacagccaagaccaggggagaggcggtgatgcaggctgctgacatgacagaggatttttggaataggtgaggttctagtagacaggaagaaaaaaagagcaggatctgagataaagggagcagccaggataaaggcagatatgtcacccaacttagttcgctgaggaactaatggttgaatggtgaagtaagttaagatgatacaggtgaggccaagattgtcaggtgccagatgccagggatgggaatttggatcctcttatttcttcctttttagtttatttatttattttttgagacacgttttgactgtttcacccaggctggagtgcagtggcacaatcttgactcactgcaacctccgcctcctgggttcaagtggttctcatacctcagcctcctgagtagctgggactacaggcagctgccaccacacctgactagtttttgcagtattagtagagaggcgattttgccatgttggccagctgtctcgaactcctgacctctactgatcctcctgccttggcctcccaaagtgttgggattacaggtgtgagccaccgtgcctggcctcttccttcttcagaactgggtagacgcaagtcttgaaagcaggctccctgaaacgccgaagagaagttataggaggggaacagaaggacagagaggagagtgagtgcatgagagacaatgagaaatacagaacaaccatgagagagcatgggagagagagagagagagagaatgagtgaacaagaagcagtaaagagaaggcatgagagaacacaaaagaataagagagagagaaagtgcaaaaaggagagtgagaagtcatgaggaagacaggaacagaaagagtatgacaaatactaacaaagcaattgagatttctacaagaagagcaacaggacatagaagtacgcaggctgcttagctcagggaaatgggattgtttaggacacacgatacaccacagcaccctaagaggaaagtcaccaccctgggtggtgagaagatcccactcaaccagagattatgccattctcgccttctctcccactgtaaagtaatttgctgcagtcatgcactttaatggaaatctgatttaaggtttaactctgggccaacttctataattaactactgtaatctgcaatctcaaactgggaatgcaattaagacagtttaaaaatgaaagcctcgtgacatcattattattatttagcatttataaagcatgtcaaattttcaatatgtgcctcacgtgttcattcattttacaaccactaactgctgttccatgatgataccaacagcaacttttaattatcttcccccagccccctggcaaagagaatttttttttttttttttttttaagaattcagtgttaggtctatttaagtaaccagagactctcccggaagatcccaagtgcttttgggaacagaggctttttctaattctcgggtgagaattatgagggttgctatttactgttttacaaaagtaaagatcatctaatgaggcagttgaagtgccagatacagggcccgggtccccagaccccagacagctgatcccaaggcaagtttgctctggcagctgtgcaggtggtcaggcagtccatacacaagtttttcaaatgtctgggtgttttgctttgcaaaacacactctagctgcagattttagtacacaattaaaagtaaaaactaaactttgaaaaaagaacagctacagcccttgctatttatcaagcttcttttgacatcatccccactgctcaaataaacaaaccaacaaaaatcaatactaaacctcttctttggaacatggatccttttgaatatctgatgaatattagggattcctcagtcaggtgaattcacaaacacaacatttttgggggataatagtagttaagtcccatggctaccctgctcctacaggatatggcctccaagacctccaatggcaagtggtaacctacagcatatgcattcaggatagggctatgagtttcagataatggcaagtgttagtgcacaccatatgtattcaggagagggctatgagtttcagaggaatagtgaattcttcgcagctgtccacagaatttttgtctgaatgtgtatttttctgggcaaagtgtacataatcctctagagttgatatatgaatagctatcacaaatacaaccataattaacgttactaaagcatttagcaggttgtactcagtattctaattattgtatatgtactaacgcatttaacacatgagtatcacaggaggtgggtataatcatccccaaattgaggtgaagatctgggagaatcaggggttacagctttatctactgtcaaatatccttccaagccagcaaacctagagaagccctacaatgagtgatggcttagtctctttgtgttcattaccacaaccaactctgccatatacttgtgagacagatattacctacccccctttcgcagatgagaaaaccaagactcagaggtagaaacaaattgtgccaaattaggcagcctgtttgctgtcagtctaaaaaattcagctctttttattcaacatgatcctgagtccccttaatgaaataaaaatattgcaagactgctcaataaaaagttattaatttaatatatattcttcacggcctactatgtgccctgtgcttgtaggcagtagctaagccagcaagaaagattttaaaattagacaaaaaggttctatatatctaaaactgcaaaccacgataatagttatgaaggggaggaaaatgctaggtcctatgtgagtagcaggacaggacctatattacaccaggtggtgagggagggcctctcataggcagagacatttaagctagagtctgaagggcagttgggaagagggcaggtagatcaagattaagagagggagaaaagtatcttaagacaacagaataccatgtatacaggtggaggaacagaaaagagtgtggtgcatttgagaaactgaacagaatctggagtatcaggtccctggggcctgagaagtagagtgatggaaacaagatgggccccctcgcaaatcatgcagagtctcacagagcaaacgccatgacaaagagtttgagaagcctttggttttgagacacctacacagactacagtaaggtcaggaaggaaattaacatttattgagcatctacaatgaatttacaataagcttataaatgtatttttaaccttcattttatagataaactgagtctcagaaaatttagggtttcctagctattaagcagttacagttcaaaccaacactgtttcaccacagcacatgcagggcagttaggaatagctggataatgataaaggagccactgacattcaccagggatcgacaacatcttgcttttaagagctctatcagtatatattttaggttttttgagcccgtctctgtcacaactacttacccttgttgcagcatgaaagcaatcatagacaaacaatatataagtaaataagcatggtgtattccaataaaactttatttacaacaacaagcggtgagccagatttggcccacaggtcatagtttgctaacctgacacagatgtgatttggttcatttcccctcaaattcatggcaagtataccatcacccctccttcttcatgtcacttgatatatctttgataacacttttcagacattacgttgtctttctttgttgtgttattttcttgccatcactgataacacaaaggtacccaggcagtagtggtggccaattacataaaggagtccaactttaataacattcctttaaaacaaaacctgttacctttaacaagttcatagaaggaaagtctctgttttgttcttttttcctccctgacattggttggaagtgaaaaaatagaaaactttcagagtaagccagctactttgcaaaggttattgcaaatagttaagtactgcattgtatttaaaaacactgtagcatatacgtgaagcacagtaagtgcaactattaggttttgtctgtgcctattccaatcacgaatgctaatttagtcccactgtagcaggcatgaggttgataaaaatcaagcaagcatgtttatattagccaagataaggacttttttaaaaaaatcacaggttattttaattctgaatgttgttgctcttgtttaagcatctgtttttgtgaaactgtttttcttttttgttgtttttattttcctgatgaattctaatcatgtcttctaatccactggcagccaacgaaggaaaataaatggtgaaggaaatgagatgcagcttggataattgatgtttgtatgcctggatttaataaaaaatactctgctaaattagaggggagtctaaatagattcagtcaataaggaagtgattcaggtgaggaattcaatcttgggctttgttgtaataatacaaataaaccaacagattggttcgattgggaccagatttgccttctgctgaaattatggcaagctgctcaggctcacttttctacctttggtatattcttggagtttgaaattattttcttttgtgtgacttcaaatgccaggatccttggaataaagcaactcatgtacctccaaaatagctaaaactgacatgtgaaaaacagcattcctcgaaagataccctcccactctgcccttttaatttcttccaaggaaaaaagaaataattttagtgagtccacgatcctgcctgaaaatctcagaatcaaaaggaaatgtcttatacaacacccttaatacaaaacaagatttgggcattttaaattcatcaattgagatgaaccaaccattttattccaacttctctgaactgatagcatggaaacgacatcttatggagagatcctctggggacagtaacttgatggagagtcaagtttccattcaggttgacctctgaaagcagtcaggggaacctagggaaatgggtctaattagactccaatctgtccttattctgtctattctcttcttcctaaattcttcactttacttatattctataatttactccttggtagaataagcaaaactgtatggaggattaaggtttattgagtgttaattttcctaggtgctaaaattatgtattataactttccctggtaaataaactcaatgagcttaaacatcacacagcagtaggcaatggtgtcaagatttaaattaaggcggtcttactgtaaagtccatgttcgttccactccctctggcagtctctctataatcagagactcccaagatgagtcaggagttccagctccatattggtcctatttccaagcttcaagaacgtgcttctgagtcctgtattctggtgcccaagtatttcttgctttcaaattttgctgctgaattaaaatcaatcagaggtaagatatcttgtataggtttgtggaccaatgggttttagttctttacaatacagatatttcctgtttactgataaaagagttgtccagagctcatggttttggcatttcctagttagatggggctggggaggggtcatgaaggtacaagagtggggcctggccttcaaacactaaactctgtcctgagctgaaacagatgttcctaacaagaactctctctgcagactgatagctcctcctctccatgtctgaaacactgaaatgtataccattgccactattattctttgaaattatggccataaaaattctaatggtgagacatcatcatcaatacagattttagatatcaggcagtggaatggccactggtaggcatggtaactctgtaagtggctgcttgaagaatgatgatgggggcacattctagttagttccatggcagagatctttgaactgttaacaatgtctgccatggaagtggaggaaagagtcaatgcaagtgtataatacatttgtttccctaactttggagttacatgacacatatttacacataattacacataattacaactaaaggtttagtctgtcaacattgcccctcctttaataacttttacaaagaaaatatcaggcagtaaagaaatccagttcacatcctgcataaccaccaagaatatattaattatgtatgattaggtatatgtaaagcaaaaaatttaaatatagacttccagctctaaatagaatgaagacatcttccattaggaatactggtatagcttaacaggttaaaaactaatgtgaatactgcaccatataaattataaagccatacttcctcccaaaacaaggatctgtttccttaaatcaaagttctccaaagtatattgtacgaagtattagacctaagtaatgctccttgaaaaaatcttctggtcaaataatttggattctaccttaatgtgaactttagcagaccatctgtgttctaaattataacaccttaatttagttattttctgcaaaagagtcaatgggttggaaatttgatctgcagagagctgtcagaaaaggtgttcaggagctggtatgtttgtggttaggtggcacagagatctatggtccttctttacaaagatgctaatcatttcattatttaggtcaaagttatagtatctacaaaagtagaaggctttcacaagcaagaacagcaactacaaaggccctggccaggccaagggtggcatataaatgcttctgtagttgtcagcagacagggtagtagtggttaagtcaggtattaacaggattttcaggagaagaaaaatctgaagatggaaatattgaatggcattataaataggaaaaggagacaaggagttaaaaggactgaagggcacagagatttgggggaatagcacaagcacagtttctatttttttacagccatagttcccgtatccttttgaactgagaatcagaaccactgccatgattacaaaaaccatttggacatttagaatggcaaatgcaacgttcttttttgagtgctgtgtgtttaaaataaatcatgcaaaaactaccataatgtataatttggccacagagatattcaaagctaaaaaaaaatagagcaaagagattttggtcatactatttcataaaggggcatcaaaaggcttaaaaaaagagtcatataattctctcttaacaaatcagctattagaattgactcttcagaaatatttggttacaaaactgtctttccagcttaacagataattgctttcaaagcaggatactcattgcttataatgcagtatctatattttatttgtaatgggagctacattggtgcagattgagaatatttattggcacattctttctgagccatattttgttcaatcatctcagacttatgtcatcttgatgcatgtaaatacgtatactccatcatcatttgttggagagttaatatagagaacacccataaaattggcaacttggtgaaggatccatttattaatctataaacaggatgtctacccatctattgttgcaacatatcagtctccacagggttactgtccctacaagcaagaggaaaaaatatatttctatgagtggtttcttctcctttatttgtgattaacatcaattagaaaaaaaaatagctaagcagagagagccaaaacttaagaccacacagattcacacttcacaccacagagaaatgaagacaaatttagttaatggcaaaacccactgtttctgtaaataacaaatctaatgtaaaacgatggtggaatataatgatcctgtgaggttttaggcatctgttcaaataaacctatttgatcatttagttttctggaaaaataaggggttgacaaagattcatatcaaaaccctagtggataaatatctggctggaaagagtaaaaacataagattccagctatgatttcagtgatctataagctatttcttatagactaaaatttatattaaaattattttaagtaaaagcatttttaaaacacatacatgttttattcattacaaatctcactagtatatttgtgaaaggcaatttactgccaaatttctttacaaaaacaagtttccatttcatttccccaaatccccaccttttgttcattccagtaaaatgactctaatgccaaacctgacactcagaatcttaaattctgaaatttcagaattttcagtcactgctgaaaaaattcattagcatctcaaacttaaattcaggtaaattaagaggaaaaccaaataaacaataatgcaagaaagttacacattcaaacatgtgttataaaaatcaacaccccatttgaattagggctcctctgaaatccctgggcagggctggtgcctggtaatatttaatatcaggaggaatggaatcttgtagaattcattctacactgaccagcagtattaagtgtcactgtcaccaaaaaaacattctcagctgtagacaatattctaaaattactaatatcactgtctgaccttgctgttatctgttgtgtggaacagagatctatttatttagctgttcagcaaatgtcagtataccatgactggagaaaattagaaactacattggcagagcactccctacagcctgctaagtaaggaattgaacaaaatgctttctacctcaaagtgtctaaatcattgattggccacaccttctctcatccatggttaacctttcatggacctagtagagttctccagctattagactccttttgcaaaaggattccagaatatcatattctctgaggcacatgttaaacagactatgaaaacatcgtgatttgggacctagctgtgctgcagaattgtcaggggcctctccagatcctctccactcttttgcaacctcctcttggccctgggaggctgactagagagaacggattaatgggttccttttggatctgatgtctggggagccctggcaggaggagagggaattgggggcatttattcccccgtccctcccagcacgattgtcttgggtggctgtttcctccacagaaggtatcagagcatctcaaaaaagtcttcattacaggatattctcttctggtcaagtagtcacctccttctctctctctcagcattgggacagaagcgatcccacgctgccagccccaggttcctttaaccccacatatattgtcattatcaatatttttaaaaataaactttcctccatatactgtgagatgagtgtgccattgtttccttttaagactaactgataatgtgccattttgaccaacccagcttgctcttgggaaaatccattcaaccttctagaactggaaggttaacattttgttcagttaccccctctccacaagataaccacggtcatgggttacacaataaaataaaagtcaaataaagctgcacattctcagcacaagccattaaatgagtattatcacaaacatttctttccttggctctttttgggacatggctaatacctaagaatctgaaattgttgctcattagctgtctggatctacaccccagttaaaggcagaaaaaggaaaacaagctaaaggctttattatcttgggtcctgtccattacaaatgacagatgatggcttgtcaggtgaaaacgagcttctcagcactaaaacggcttcattcagtttattagccacaaacaaaactaaggaaggcccactaagaaagtgacttgaaatccttattttcagcatgatgaaagatgggctcaataagactgaatccccatgtggtcttccagtctgtctaaagaaggaacatgggtaacatggagacaaactcgagaagatggttagtatttaaaaatgtaggtctgcaaccttgaacaaaaagtgttaacttccataaaatgccaatgacccagctgcaagtagtcaccatacatttatctcaaaagccacattattctgttctactaagcaaataaactgtgtcattgagctgttaacagtcaaccaaaaaatatacccaaagggaatacgtataggatggcttaacaaccaagaaaaaccatgcggaaggaaactaaagctctcaaattccacatggcttttctaggaactgagcagcatccagtaaagacagatacacacacagtacctaagtccacaacgtagacaagcatttgctttccagatatgctagagcttccttttgtcttccctgctctgtaactctcctttattctctgaaatgtctggacaaatgtccctgtttgcagacgcctacctcatccatcttatcacacatgtttctcagtgtgggtttatctcatgaacatgtattttccaatatgttaaatccaaaaaatagtttttaacttatttaatgtctattttgtgtcctatcaaaaaaaagcttcttgggttgaaaaaaatatttttgtaaatgtcttgacctgccacctttttattttcatgattgctttgaatatcatgtcaaagttcttactccggaaacctggatggtcttctgtgttgctcaaggctagctgagggcatctcccatttttttgtttgtcttgagtaggtgatgcttcctgtaatgcccatttctgctacacgagttccctttcatactatgccatctaactcgactccgaagttcttgccacctagttgagaagactgtaatctctgccttggcagatttgagaacaggaattccatcccagtttcatgttacagttccaaatgactgtttttatagatgtatcgagtacattgatgttgggggtacttcttatgggagattatattgactaactgacttgcagagtgttaattttaattggaaggggtggtttcaaactcagtgccagacaggtaagtaaatgagtagagaggtattagattaagacaacagaaaatactctgacataccagcaaggacatgccttttcaaatggggcagttgctacacaatctatccaattgttgccatgcgaatgtaggccttttatgcccagatctttcctgttttcaaaagccaaaattctggatttttaaaaacactaggcttactagacaaaatgtatctgagagcagcatctgtccttactgcttaatctgtgtatctcccacaactaggtagatgtatcaacatcccagaagatgctttccaaaccagtgcatctttcctgatactatcactaccctctctaacttttggattttcccactccctcaaataatctgaaaatttctatttcttttttctttatgagatgcaatcttggctctgttgcccaggctggagtgcaatgtcgcaatcacagctcattgcagacttgacctctcaggctcaagtgatcccacctcagccgcctgagaagctgtgactacaggcatctgccacatgcccagctaatttttaaaaaagtttttggtagagatggagcctcgctatgttgcctaggctggtcccgaaatcctgggctcaagtgatcctcctgtttaggtctcccaaagtactgggattacaagcgtgagccaccatgcttggccagaatttgaaaatatttctgcatataatgaaatattcgaatggaaaactgttacatgtgtgaatgttggaatgcagaataaagctacacagagagagaaaagaaaccaagcaagtttggagaaggacacaaggatttctccggctacaaaacgaggattgaagagttatacaacatgaatttacacatgacagcaatcatgctaaggctgaagtagctaacacttcttaatcacttactagatgctaggcactgcctaagtattttatctatcttaacttactgatatctcaccacgaccctataaggaaggtaactgctttccatattttacagatggcatacagtatagaggcattaggtaactcctctaagccacacatttgataatcctaaaccctcatgtgactccagatctactgtgtcatatggtttgccttatactcttctactctaacaccttcagtcaccttactggccaacttggctgaaatccttggcatagcctaaaatgtcctttatatacaccagatgcaacacattccttaaacatgagacaaatcctcccttgaagatctccttccatggtagttttaaaatatgcccacaaatcccttaatgttcctctcttcaagatgtagagcttaatcttcctcctctggagcatgggctgtacttagtgattcattctaatgagcagaatatggtacacatgacagtgtgcgacttttgagaccaggttatgaagggtattggggctccttcctatttgttctctctcttggatcactcactctgggcaagccaactgccaagccataaggacggacactcaagagacttctatccagcaaggaaccaaggcctcaggcctcctaccaactgccatgtgagtcattttggaagcagattgatcctctagccccagtcaatcaagtcttgagatgacagtgaacctggcatacttcttgactgcagcctcatgagagaccctgaggcagaaccaacctacaaccaaaaccagatgtcacttatcaataaactcaaggttgaattgttggctcactgataggcagagttttgaataagaatttaggtagctctttcaataaaatatttttcacatttaaattaatggcagattgctgaataaaatgtatatgcttttaccatttaatgaccacatatgaaaattgaaactaatcctttgccatactgaaatatactaaactgcaagttctaagaagtgacatagatttatactttttaacagatgattttcctaaattttatacttaaaaaatcccactataataatactgctttggaaaatgctagcttttttttcttaatcaggactatgtacagggaatatgagacaatttggtatcctattagaatcttatttctctgacatgagtaagttgggctgatttctataatgatctgttacatatgccttaagtcttcaagtgcaatgtgagttaaatgaaaagtactgtggagttaacatcacaattacatcttaagaaattgcaggagataatctaaatttgttaaatatattgctaagtatatgactatccacataaagcttaatcaatttcataataaaatctactttaaaccctccaaagttctgattgtgttccttaatatagactattgaaaattattaaaatatctggtttagtgctacaataagtgaattaaggcaagatcagtatgaactacaactgagacaggtatccactagaggccagtgtacttcggcatggagaaggaatttataaccaattcctgtggaaaaaccaaccttattcctaccattcaaaagtggaggtcttgtgaagtgaagaaaaaaaagatgaagaaagctattttgattctctgaaaagaaagcttcagaggataagaaagatgagttaaggaaggatgagtcatgaaaaaaaagagcaaagagaattcttgtctagagaaaaaaaaatagtactaccatacactgtactgtttgatgtttcaccaacgtaagtgtaaattttcaagatacttggtgtaactgtaagctttttcataaatgtttcatttggcaatatattggaaataattaaagatctggagtacctagaaagtaccacagtaatttcattttcaaggcagtcatcattgctagctgcctagacaaggccaagggttttgaaatgggatggaacaaaactgcatgtctgcaattttcttcccttaaacaactgtattcagaacaagtaccaaatggttccttctcaaacatggaataattcatataaattcacctagcactacattcatattgtaaaatacatttcttaataatggtgcgacacgatgcctacaatactttttaacaaggaactgaactagtttctcaaaactaaaaatcggagtggaaatgaaaatctgattctttagtaaaacgtagacaataatagttggtaggatcctgagtaggagattttactttgtaagagtgaaggctgaatgatttaacacataacccacagatgtgtactctttccccttttcctccagcagagaaaggcaccttatgtaatgtgggcatgccggggagatgaatgaaccagaaaatcttagagctaggcaggacctgagggttcagccaccgcagcttgaaccttttcaaagacaaaagtttcctcctttgcaaggtggcccattgcatccctccattgcattgttgaggctatagctgtttgaaagttattctttaatctttatactgggggacctcatctgacacaacaaaatactgttctggttcctgaggccaaaaagaggacataagatacaaagataaataatacatgatcctgacttcgaggagctgtaaaattctacccatgcagtaggttctgattctgatctctgcaacaaaagcactggctctatcacttattagctgtgtgaattagctaacttctttgggcctcagtttcttcatctttaaaatggggataataatattagtacctacctttgcagggttggtgccaggattaaatgagataattaaaataaggcactaagcccagtacgtggcaagtggtaagtacttattagcagtcagcaattattgctactcactatttacctggcatataagtaattcaaccctttccaaactcctatgagctatgattttattaccattatttttagagacaggaaaactgaggctcagaaagctgaagtagtttgccaagatcagcagctaattaatggctagacaaggatttgaacacaggtttatctaatgacaagagctttaaccattacactaagctgttctggtgaacagtaaggcaacttcctaatcctaaagtgacagggccagtattcactgacaaaatctatgacaaatccaaaatttttcctttctctgatataaatatagttagtgccaaaagctaaccacaagattcctcccttcctagccatgggagaacaggagccctggagatggaagaatctttgaagtccctgagccctgcttccagtgagccatcctgcctgctgttccaacctctgttcctggagcccataccatcctggttaatctctgcctctgtagaggtggggcttccactacctttaactgttcttcatgggataatcacaaacggcctggacctctcctggaactcagggataacaaaaaagtattgagagagaattatctagtcgggaataaagacacacaggtgaatgttataagaaatgcattcagtgaaacctttgaaatagctgtgtgctctctatgccaagtcatggatttaaaaaaaaaaaaggtctgcacaatgttaggatcagaatacaatggtatgacacttaagagtacttccaggttgcttgcttcctgatattacaaaagcacgctcagtcatctctgtcctctatcaccaagcactcagtcctgtgatgaaaggatgctggcattctatttacatcagctaaatttacaaagaaactgactttctgttgatggcctgttgagaggaacaaattaaaataactctaaatcatgtctgtaattttctgaagagatacgcttatcacaccccacttagaacaccaggtcagatgttatctcggtctctcctgatatagattttctactcctttgaacttacaagatacagttctgcctattcattaggaaggtacataagaaattggcttacaaactacagtgaatcagaatgtctaattgtctgactctggctctgagaaatgtaactaaaatcatgaaccataatattaacaaaaaattatggtcctttatctgggaaggtcttttatgaatgtgctttcattagctagtaaggccagaggaaacaatttaaactcaaatcttagtgactgttttcttaaagtcttatattaggagcattctgtctgaaatgttaatgagaagagaaatctatgttgatttgacccccaatttatgacagtatgatatgaaatttcctcctccttgtcaaaaataaggcttctccaaataagtgtcaaactattatgatttacaatgatttaaaaactgttattgacatgattcacagagtggacaataaacaagcaggaaaagaaaataggataattgtgaggtgaaaaatatttagaatgacaggttgcatgattaaatgagaagctgaaaatcaaaagctgctgaaccattcaatcatttcacagaggcatgtttctctttaagatgtttaagaaaaggtgagggaaacagaaaagacactgcaaggaaggcagggatggtttgattgcttcatgaagataattaattggaatgtactaggaagctgtaggctttgatatgggcagcagcacccagttggcttgatttattattatggttacacagaaaccaacttatctgcaaagcataaagtacatacttgccatcctaaattcaggagaaaaatggggaaaatggacttgggtgaaaaaaggaaaatgaaattgaattgagtctgaagtgacttactatcaaatataagtccaaccatttgtcacaagtcaggtatctcatctacaaaataggcaacgtaataaactgactttactaaaatgtactgacctgaaaattgtttgtgattttgttttataacaatgcagtataccacactggtggtaagtgagaaagataataatctagaatgtgttccaaaaacaaatttggctgtatattggcaaattatattttcatctctgacttcaagagaagtaagggaaagaatgaaaaacaaagtagtaggatgagtattattaagtatgagtgtgggatggtgtgggaaataatagactattttcttgttactgatttgcaaaagtccatacaccacaaagtaaaactatgttctttctctgttaatttgatattgaagagcaaggagaatctcaaggggactatccaatccacaactatcctacaacatgacttacagacacatgtaggagtccttttcatatttcaaaaaacaatcctccattaggcagcatgataaagtaaaaaacaaaggaatagatacacacacacaaagacatacaccatatgcatactgtgtatgtgtgtgagtgtgtgtgggtatttatcttaattctaaagaaggtgcttgttgtgtgttccaatgagagttagtaagaaacatgactgtcatcttttcctttccccttgcagtaatcctagttttactgtcaggcacatatgggtttttcaataaccataactcagataaacatgtaatatctaagaatagttaactttttattaagggtgttagtctgtgtgaggtgtaatgctaagcacatcataagtatcaggtcatttcatcctcacaagaagttcaggtgttgacactggagatcacagaggttagtaacttgcccatagtcctacagctgcttaatgtctgagcaggaatttcaatctgggcccatctgaccatgcagcttacccaaactcttatccaacctgataccccatctaccacatttaaagacccactgtcattaaagacccattttaaagacccatttaaagacccactgtcctaccactgccagagtaccccacatatgctattacagtataacatgaccctagacacacgctaacagagtcctttttatatttcccaaaacaatcctctctcagcaaaaaaacaatcaaagaagcagggatgcataacatttcactagcagtcagttgggagacctgggttctagtcttcgctctgccctgctttaggtacaggaccttggacacatctcttcatctctcaggacctcaataacatcacctgttagaaaatccttgagaaacatttctgcacaaacatactaaatgtataggcaagtaatagaagtcaatcacagtgaagatcactagcaccagactgttgcttttattccactatggtatgtttatataaatgttttactgctataaaaatgaaagataaatagtattcattgggagaaaggggcttagcaactccacattttgtcatctactattacatatctaggtcaaatttggcttttattaataaatgaagaatgaagacaaaaattgcaaattggaagagtttaattagaatataaagactgtcaagagaactgaattgcatccttgacataaactggactagaaaaataattaaaattggctttttaaagtctatttcggttatgttgaggagcaggatattttgatgagaaatgttttcaattctttgaataaaagcaaagaagatttgcacagtcatcagtccacatgtatatagtacagtccttcaaggcaggaagaagtttactcaaatgaggcaagtaaatgcagaacagaactgaatggctgtcagccctacctgagtctcagagactaagcttcaaaacttgaggtttttctttcaccctaaatagctctgatgagcaataaagtatgacagggaagtttaaaaaaagaacattcaggctgggcacagtggctcatgcctgtaatcccagcacttaaggaggctgaggcaggcggatcacaaggtcaagagattgagaccatcctggccaacatggtgaaaccctgtctctactaaaaatacaaaaaaaattagctgggcatggtggtgtgcgcctgtagccccagctactctggaggctgaggcaggagaatcgcttgaacccgggaagtggaggttgcagtgagccaagatcgcgccactgcactccggcctggtgacagagcgagactccatctcaaaaaaaaaaaaaaaaaaaaaaaaaaaaaagaacattcaacacaattttactaagatcttacaatatgtgtacaactgtgttgagatgtggagacaaaggaaatctgtgaccagaaagtcatagtctttgcctttgctaattttataatctagtggtgaacttgatgttgagaatgagaaagagatttcaaaggcatagctcaactaagaacatcttataaaccataaagtcccagtttaatagctacttcaccatttactaagataatgcctatagggaggtaactgtggactttttattgtctgtgcatcttactaaagggtgggcaactgacggatagggcatctgtatcatttacacttaataagcatcttcagctacaccaagagagatggtcaatactcagaaggttgtgaggacacccatcacattaggtggaagcttctggacctgagaatggaaggtagaattatgtggtcagggtctttggagacaaatttattaggctgaagaaggtaggtttttttggaccaggctgccagggttgatttagtcttgtttgtggatggttaataggtgcagtgatgtggtttggctctgtgtccccacccaaatctcaccttgcactgtaataatgcccacgtatcaaggttgggaccaggtggatgtaattggatcatgggggcggttcccccatgctgttcgtgtgacactgagtgagtctcacgagatctgatggctttgtaagtgtctggcatttcccgtgcttgcattctctctcccaccaccctgtgaagaggtgccttctgccatgattgtaagtttcctaaggactccctggccatgcggaactgtgagtcaatttaaactcttatctttataaattacccagtctcaggtgttccttcctagcaacatgagaatggactaatacacctaggaataattttatgcatttccataaaatgcatgtttgtaatgtttccattacagggctaacctgatatgagtactcaaagtctagacactacaattccctcctcccaacatccaccaacttcatttaggctctttctgtgcctggcatttgagtctatcttcctcatgcctccctcacctcttggagcccaaatactcacacatcatgctgcctttgttaatatttgcccagttttctcttaccccctgctctacaagattctgtaaagatcagagcagaacttacttcttatttccgctattttaaaataaaaagcttttagacattttaacatttttgacatcagaatcccccttagaatgaatatctccctttactgaagtgagttttgctcctaaaacaccattattaaaacagtgaggtatcttactatagctaggattctagagcagaagaaatactgcatttctgttgtttaggtcctgaccaataacaggactgacactgatactaactatacaccacttcccttcctcttgttccacttcatgaagtctctaaaggatctcatatgtttggtggaaaatcaaaactgcagaaactgataaatactctgattttgttttctctgtacttgatcttcaaggattgctttagtagaatataaaagcaaatgatggctcattcaaaaaaggtcagtgaatgacaactcttaggaactcttttgtcactgataaaaatagttccatctacctggaataatcttgtaatccatttaaacatttgtacataattcttcaatctctgatatacaatggtgaggggactcagcccactgtgcctggggaagaggagaaaaaggggggaatctaaagcccaatttaccactttctctcacaaaccggattatctttttgacatctctatttccattcacagagattcaaggactctttattttcccagttatccttctctggacggactctagtcaccaacatccctcctaaaatgtaggatgatgcattggaactgttgctctctgtagctacttactgtccagtggtaatacagggatgtgtttagaaatacggaatatagtgtaaaattgcccgggctcaacatactagctatacccatactagctctgtgtcctctggttagttatgaatctcttctatgcctccttttcttggctgtaaaatagataatcatgtcttaaaatacaataatccacatgaagtacaagatcctggcaagtcataagagctcagtaattgctggccgttactaaaaccaccagcatcacttctgccaccaccattctcactactgctgcttgatggaggaccccaaatgaactgctgcaggacaacgatgattatagaagtggcagcagcattccttgccctccaagatttggccccattttatctggctgaatatgttgcttagcattccacttttagccaatctgaacaatctctttactgtattctcctgctcaatcatccagcctaaaagcccttaccttctcttacacccttccaactcttctgctatcaaggctgctcattgagcctactcaacatcttccacccacaatcgcctccccttcccccacacctttagccagagaatcattttgcatttgaattaagcgctcttctagttttaaattcaatgtcatataagattactatgatttatggcttcctaactgacttatgaatttactttgtttttctaattacagggcaaagagtttcctatttttacttggtattgccttcttgtacttagcatcattttaggcatacagaataagatctgggtattatcagtggactgacccacacctctgtcctaagtgtattatttatccctagaattaatattgggatgcttggaaagtacgataattaattttatatgtcaacttgactggaaaatgggatatccggatatctggtaaaacattatttctgagggtgtctgagagtgtttccacaagagattagcatttgaattcatagactgaatagagaatacccaccctcaccaaagtgggtgggcaccatccaatctgttgggggcctaagcataaaaaaaaaggtggaagaagggaggatttgctctctctgtgtgattatttagctggggcatcttccttctgccattgccatccctggttcccaggcctttagacttagactggatgctaagccattggctctctggctctcaggccttcaaactataccaccagccttcctgggtctctgccttacagacagcagattgtgggattccttggccttcatgactgtatgagccaataccttataataaatctctttatatctcttatttgtcctgtttggtgaactctaaaacaggtgtagtaaattttcactggacaccatgatactgcataaacattcgagctgtcgaggtttccaatgacccaaaaataaaatttagcctcaaatagagacttgtaaaatattactataagctcaaaaggattttaatgtacagttagagaggaattccagctcaggaagatcctgcttttctgtaataaagaatataactcaattaccaactgtctcacttaatatatgacacaattcctatgagaaagattctgtactctgagagtattagagaatgctaagtctctattccaggaggttagacaagacaagattgccaagctttagtattttaaaatgtttgctttttcttgagctaaaagaataaaaaaaacaagcaaacaataacaaaatcccataatcatgattatttcactacttataaaactcagtgtcatattagcacctgaggtcattaaggttggtttgtacaataaccaaaacatacttgaaagcaagtaaaacagacatataagaaagaatatattaggtgaaaaagaaagctctgattacccaaaatgctaataatggctctgcacaaacaattaaaactcttcatttcaaactccatttgttcagaatgtgaatatggaggactcttccacaatttacctttgcaatatttaaggaaaagtatttgctgagtaaaaaaatatatattacagtaagactgtaaagaacatacttaccatattcaagaaaataaacttttctccagtattgaaatgtctcatttataaatacttgattccttaatagcatgacactcttttctgctaattaaaataggtggcatgctgggcgcagtggctcacacctgtaatcccagcactttgggagcccaaggcaggcagatcacgaggtcaggagatcaagaccatcctggccaacatggtgaaaccccatctctacaaaaatacaaaaaattagccaggtgtggtggttcgcgcctgtagtcccaactacctgggaggctgaggaggggaatcacttgaaccctggaagcggaggttgcagtgagctgagatcttgccactgcactccaacctggcgacagagcaagactccatctcaaaaaaaaaagtggcaaaatccatccatttgaccaagcatcctttgcctactttaaacacataaaataataagtaacactaagaatgtaatttacaataggatttcttcctaccgattggccttatactaaggatgaacaaaaggttttatatattacctgaaagaacggtttttttgctgaatgaaactgattattagtaatggttccagtcacctaaaatagccaaaggtatgtattttatgttatcactcttctttttttagaaaaacattttcctttaaaagtagcctaccaattcacaggtgaaactgaatttattgttgtaagatcaggctttaaaataactttgaggaggagaagcccttgacaagaaagtaaacaatagaaaccaggtcagcaactgaagacctgattttattgttcatagacacaaatgcttggtttcagaaatgccttaatatcaaggaagctactggtcaaaagtatttctatgggcacattatatcccagaactaatgttgtcaattgactatctagttggtaggaaaagtcagttcaaccttaaaacctaagttaaataggaagaggttccaagatggccgaataggaacagctccagtctacagctcaagagaagggtgatttctccatttccaactgaggtacgaggttcatatcactggggcttgtcggatactgggtgcagcccatggagcacgagccgaagcagggcagggcatcacctcacctgagaagcacaaagggtcagggaattccctttcctagccaagagaagccctgacaaacagtatctggaaaatcaggacacttccacccaaataatgcgcttttccaacagtcttagcaaatggcacaccaggagattatgtcccatgcctggctcagagggtcccacaaccatggagcctcactcactgctaccacagcagtctgagatcgaactgcaaggtggcagcaaggctgggggaggggcgtccaccattgctgaggcttgagtaggtaaacgaagcagccagaaagcttgaactgggtggagcccactgcagctcaaggaggcctgcctgcctctatagactccacctctgggggccgggcatagctgaacaaaaggcagcaggaacttctggagacttaaacatccctagtggttctcccagcacagagtttgagaactggagaatggacagactgcctcctcaagtgggtccctgacccctgagtagcctaactgggaggcacctcccagtaggggccgactgacacctcatacagcagggtgcccctctgagacgaaacttccagaggaagaatcaggcagcaacatttgccgttctgcaatatttgctgtcctgcagcctctgctggtgatatccaggcaaacagggtctggagtggacctccagcaaactacaacagacctgcagctaagggtcctgactgttagaaggaaaactaacaaacagaaaggacatccacaccgaaaccccatctgtgcgtcaccatcatcaaagaccaaaggtagataaaaccacaaagatggtgagaaaccagagcagaaaagctgaaaattctaaaaatcagagcatctctttccctcaaaaggaatgcagctcctcgccagcaatggaacaaagctgaacagagaatgactttgacgacttaagagaagaaagcttcagacgatcggtaataacaaacttctccaagctaaaggaggacgttcgaacccatcgcaaagaagctaaaaaccttgaaaaaatattagacaaatggctaactagaataaacagcatagagaagaccttaaatgacctgatggagctgaaaaccatggcatgagaactacatgatgcatgcacaagcttcagtagccgatttgatcaagtggaagaaaggatattagtgattgaagatcaaatgaatgaaatgaagcgagaagagaagtttagagaaaaaagagtaaaaagaaatgaacaaaacctccaagaaatatgggactatgtgaaaagaccaaatctatgtctgattggtgtacctgaaagtgacagggagaatggaaccaagttggaaaacactcttcaggacattacccagaagaacttccccaacctagcaaggcaggccaacattcagattcaggaaatacagagaatgccacaaagatactcctcgagaagagcaactccaagacacataattatcagattcaccaaagttgaaatgaaggaaaaaatattaagggcacccagagagaaaagtcgggttatccacaaagggaagtccattagactaacagctgatctctcagcagaaactctacaagccagaagatagtgggggccaatattcaacattcttaaagaaaagaattttcaacccagaatttcatatccagccaaactaagcttcataagtgaaagagaaataaaatcctttacgggcaagcaaatgctgagattttgtcaccaccaggcctgtcttacaagagctcctgaaggaagcactaaacatggaaaggaataaccggtaccagccactgcaaaaacgtgccaagttgtaaagaccatcgatgctaggaagaaactgcatcaactaacaagaaaaataatcagctaacatcaaaatgacaggaacaaattcacacataacaatattaaccttaaatgtaaatgagctaaatgctccaaataaaagacacaaactggcaaattggacaaagagtcaagacccatcagtgtcctatattcaggagatccatctcacgtgcagggacacacataggctcaaaataaagggatggaggaagatctaccaagcaaatggaaaacaaaaaaaagaaggggttgcaatcctagtttctgataaaacagactttaaaccaacaaagatcaaaagagacaaagaaggccattatataatggtaaagggatcaattcaacaagaagagctaagtatcctaaaaatagatgcacccaatacaggagcacccagattcataaagcaagtccttagagacctacaaagagacttagactcccacacaataataatgggagactttaacaccccactatcaacattagacagatcaacgagagggaaagttaacaaggatacccaggaattgaactcagctctgcaccaagtggacctaatagacatctacagaattctgcaccccaaatcaacagaatatacattttttctcagcaccacattgcacttattccaaaattgaccacagagttggaagtaaaaaactcatcagcaaatgaaaagaaaagaaattataacaaactgtctctcagaccacagtgcaatcaaactagaactcaggattaagaaactcactcaaaaccgctcaactacatggaaactgaacaacctgctcctgagtggctactgggtacataacaaaatgaaggcagaaataaagatgttctttgaaaccaatgagaacaaagacacaacataccagaatctctgagacacacttaaagcagtgcatagaggaaaatttatagcactaaatgcccacaagagaaagcaggaaagatccaaaattgacaccctaacatcacaattaaaaagaactagagaagcaagagcaaacacattcaaaagctagcagaaggcaagaaataactaagatcagagcagaactgaaggacatagagacacaaaaaacccttcaaaaaatcaatgaatccaggagttggttttttgaaaagatcaacaaaattgatagaccactagcaagattaatcaagaagaaaagagagaaaaatcaaatagatgcaataaaaaatgataaaggggatatgaccaccgatcccacagaaataaaaactaccatcagagaatactataaacacctctacacaaataaactagaaaatctagaagaaattgataaattcctggacacatacaccctcccaagactaaatcaggaagaagttgaatctctgaatagaccaataacaggctctgaaattgaggtaataattaatagcctaccaaccaaaaaaagtccaggaccagacggattcacagccgaattctaccagaggtacaaaaaggagctggtaccattccttctgaaactattccaatcaatagaaaaggagggaatcctccctaactcattttaaaggccagcatcatcttgataccaaagcctggcagagacacaacaaaaaaaaagagaattttagaccaatatccctgatgaacatcgaggcaaaaatcctcaataaaatactggcaaactgaatccagcagcacatcaaaaagtttatccaccaagatcaagtcagcttcatccctgggatgcaaggctggttcaacatatgcaaatcaataaatgtaatccatcacataaacaaaactgatgacaaaaaccacatgattatctcaatagatgcagaaaaggcctttgataaaattcaacaccccttcatgctaaaaactctcagtgaactaggtattgatgtttactgtgacactattcacaatagcaaagacttggaaccaacccaaatgtccatcaatgatagactggattaagaaaatgtggcacatatacaccatggaatactatgcagccataaaaaaggttgagttcatgtcctttgtagggacatggatgaagctggaaaccatcattctcagcaaactatcacaaggacagaaaaccaaacaccgcatgttctcactcataggtgggaactgaacaatcagaacacttggacacacggtggggaacatcacacaccggggcatgtcgtggggtggcgggaggggggagggataccattaggagatatacctaatgtaaatgatgagttaatgggtgcagcaagccaacatggcacatgtatacatgtaacaaacctgcacgttgtgcacatgtaccctagaacttaaagtataataaaataataaaagaaaacctaagttaaatacaaacaaataataattacttaggggtcagcagctggtggctcaattgggcactggagaccatgtttgttctctttgggtggtacattgagggtgtctaaccttaagaaatgcaggaaggggatgatggatggtctgttcagattccctttgtcccaactgcatttttcagctgtcaagagatactgttagcaggcactagatttaacaatgggaggctagatgggaggctaactaccttttgaagtacacgcctggcagatgacaaccagcatctttacttttaaacccagcaacagtgggttgctaggcattgttttgctggtttattaaacttgtttcagtaaagaagcagcaagtaactggctgcatattatactagactaagaagctttttacagacagcaattggtcttagtaaatgctgtatcctgcaggtctaggacagtactagaggtgataatattaatttatgatcaacaaggtctgatttgaaatacaaagtcacatgcactggtgaaaccttgggcaaacagctgcgaaggaaactttctgtggtcaactataaacgttccagctatacaatattatattccaaatttgttgtttattttttatctaatttctatccttatgcctagagcttcctttttctttacacctggtaaaatcctgcctatccttagaagcttcatttaagattcttcttgtgacctctcccggcataattacccttcacattcatccaacatggtgaccccgatctgctaggttctaagcctccagttgttaccatatgccatcccattttacctttctgtcttttatatccctctggttcttctatcagaatatagagagaattatcaaataatcacattgtatgactcgctctcaagcttttgaatttgctgaaggacgaaatggaacctttgttatttcggttaccctttcacctagaaggtccttccgtaacaccacagtcagaattttaaaacgaagaggaactccatactcttttattggattgaattaaattgaaggaataactaatttctctcgagcttcctgatcttaaaatcctctgaataggtaagaaataaagctgagatggtatcttgttatgctgtactgttctcccctatgttaggggaaagggtgtctattatttgtcttttgggtttttcctcactgtacttctgggggttgggggaggttgctgctagccatttcctctagtaaaagttcaaaatagcccttctataaaagctaccccatagaacaccactttataaccatttgaaaaaccctaaagttgacctccaggagaaaccacttcatatggcttccccaaaccctgtttaacaagttttaaaatatttagctggaatgttacttcaagctaaatatgctactggtttattttttcattccatttaccagttgtgacctcatctgtgcttgcaattggctgaaaggaaccaattttattcagggaaactttcggatgtgagccgtgatgcccactgaggataaagataggaaggtgcgcacggtgggtgtggaaggagggagaatcctttctagaagatgggggagtgggcccagattcaagtgactgagtgacctttctttttgctagctgctgtgtgaggaaaaaaggctatttcttcctgcagagaactgcgaaatgaggtataaactgagtagcgaggtagatgagcctaccacattagctgattaataagcaaactgctcaaatgcccagagggatagagagttcctagcagaattaataataaatccagacattgggtgaattaaatttaaggtgtaaagactaaaccagggtcatattagctaggaagtatgaggtgcgggatttagtaaaaaaaaaaaaaaacttatttgcacagagatgcttagttagcctagctctacaaaaacatctataaaacacagctttttaactgttttcttgctggtttaataattagcttaatttctgttcacaaaaaattgtagttaaaaaaaagctttcaatacctacgagaactctgtctaattgagccatgagggcaaatccaagaggccaccacacatacactagaggttgacaaagtgcatgagaagaagcaggtctcgtaagtactgatcttgcaaccccaaatcactaaagtacgagtaactgctacaggagcaaatgaaatgatctgtcagaaatctctttgaaaagcagaaaagtgagcacacaaatatatatgatcatttctgttgtttaacataatcaagaaattgatgctgctaaaataagttcaatttaaaattgtggccaggcatagtggctcacgtccgttatcccagcacttcgtgaggccaaggcgagaggatctcttgagctcaggagcttgagaccaggctgggaaacacagcaagaacctatctctacaaaaaatgaaaaacattagtcaggcatagtagtgcatatctgtagtcccagctactggggaggctgaggtgggaggatttcttgggcctgggaggttgagactgcagtgtgtggtgatcatgccacttgtattccagtctggttcctgtctctaacaataacaacaacaacaataacaacaatgtgggactgtgaatctgcttttaaatattgtacatagggtacctaacaaaaaaaggtgttaaaattatttctcaacacttaggatgagagaaggggaaggccagcagtaatattttatactggttgggagaagggtagatggcagtcaaatctgaatacaaagcaaaggctttattttaaaaatgtatttccttctttatcagatttcatatatatgtgactatgtataccacatagcaacatgagatgcaatgagttcatttcttttctcttttcattccaaataaatgggcaagagaactgcacccaaaagggctgggtcaagtccaatctgatacattgtaccagttcttaaatgtgcattctttctacgtctcaactgttgttaggtaagttcttcaccagtaactaatgataattaaatatataaatctgtgaataatgtacttgtgcttctaaatgaagtacaaaagactcaaggtcaatcgtataatagctttttctgcactcacttgctttctcctgtttatctgcttgagtgggtaaactacagtaggacctctcctccatgggctggtgtagctacagctgacaaaggtttgaggaccacagttctcattctcagcaaatcacaagtacacttgtatgactgcagtttgcaaccttgtaatattgatttaggcccaaacaatatgctttcaggatcctttaacaattattttccttttgaacaaaacataggaagaataataaacttaaaaggctataatacctcaaacttttgcttcaaatgcaaggtggctctggctgaagcagaaaatatgtattattaacactagcagttgttaatagtggtaatgataatatgttatctccaccacatggcgataatgggttttttattattaaagtaagatgccacctttatttatagacatcgttaagtcagagaaaatgaaaatgcaaaattactacacagttcaaattgcagcagcccttaagactcagtggggagaatgtacatgcatcatcttatggattaaaaagaatacacattatctaagcccaatgttatgtccacacatatgtgcctctaaggttgcaagaataggaaagctagtgaaagtaaagaaaatattttttagatgtgattttctattaagaaagatgggccctaaatgtaatctgttttgctttaatcaagtacagacaagacaacattatatgctcactcaattatgactgttttccccttaaataacttcacttaggaacaaacacgaacatagctaaatggaatttccactaaccattaaatgtagttagatgttcttttcttcatatattttagactgaagttctattaatactgtttgtaatataagtatgtgaggaatagtgtctcccaaaagcggtcctgaaattgtatttgctatccgaagagatgcatacgttatagcagtaaatttggtacttgggaaactattttatttggtttgagcaattctaaaaaaattaagggcaaacattagttttgagcatcacagaaagatatgaaatgaagtcaagtctcaaagtgcttcaggtaattttaagaaccaaaggctcaaaagtgagaaaaataacctgcttttttctaaagacaaggctactgctaataatgaatgagcaggaaaacaaaatcttgctctgcttcagttcctgcaggagaaaaagtaagtggtctgaaactgaagtaatttaatgttcctgctttccagccctttgccagacacccatatcacagtgacccatagtggaccccaaagagagcccacaaggagatgggctcagtcattatggaaggcatcaccatgctaaataatagactggaggagggagggtaaaccaacatcaagaaggccagagggcaaatcttcattgaatggcatttataaaaatcctgtagccaaacaagaccaacgattcaaaaatcttcactggttgaaggattcggattgggaggaaccaactagcagcgatgtgctagtcaagtctgttgcctggattactataggacttttactaagttgtcactatatcatcatcaatattattactagaaatttacatgatacttttcatcagcaagtgttaggtaaaaatttaccagtatttttgtataaacatctcatttagtgcttaaaaaaattataagtgatgtatgaccaccacacaaattttcaatattatataatcttgaatacaaattatacatttttgtaggtatttaaatacaaatgcacacatttcaacttttttctcactaaacaatcaaatgtttttcaaatgttacctgtgtttaaacacctacatgtactttgtcctttttctttgctttttcttttcttttatttattgttttccttttaaatattgccattttgtaaaataatatatgatcaagataggaaatagaaaaacacaaaaaagtagatcaaatgacagagtcctaacacttaaacacattgagtattattaattttgtatatttccttctagtatgtttctgggagtggggagaagttttatgccaggtgtggttaaaaaaaatactgtgtgtaaacagagagagcaagcagcagcccccaagactgaagcttcagtcttttttataaccgaattatttcatttctattcattagatgtgagtcagcaggtaaagcccacatgcaaggggaggtgattacacaagagcctgaacaacaagagataaggatcaatcactaggggccattttaaaggctgcctgaaaatacaatcctgtgttaaacatcttctggcatcaaaaatgctggtattattttcttaagacaaaataccagacatggactacaaggctaaatgatacgatagctttttaacgtaccagatagaaacagtctttgtgtgtcaggatacatcccacttggtaatacggcttattcatttaatagttgctgactcctattcaataaataaattattacagatgttctcatccataatcatattaatatcagtctttaacttttttggctgtagagaggctggctttattataagggtaaatttcttctatttttttttaaaagaagaggcttttatgatatgtggcagtttataaaatatggatttaggtggggagaatttcatgcatcagaaaatttggttgaacgtaaagttcttaagagatgataatgattatgataaaaaattataatcatcagaataatttaattactaccattactgagccactatgaaatatcactttcccactttatggaacagaaaactgaggctaatgtagtgtgatggttttaaggatatgtccatctttaatactcccttcaagagatggaactcatttgttccttggagtatgggtaggcttagtgactcacttctagtgaaaagaatacatatacgtgatgcactgtcgcttctgcgattagtgataaaaagactgtggctcagtgcaatcaaatcagaactcaggattaagaaactcactcaaaaccacgcaactacgtggaaactgaacaacctgttcataaatgactactgggtaactaatgaaattaaggcagaaataaataagttctttgaaaccaatgagaacaaagacacaatgtaccagaatctttgggacacagctaaggaagtgtttagagagaaatttatagtactaaatgcctacaggagaaagcaagaaagacctaaaatcgacaccctcacatcacaattaaaagaactagagaagcaagagcaaacaaattcaaaaggtagcagaaaacaagaaattactaagatcagagcagaactgaaggagataaagacatgaaaaactcatcctcccacccaaaaaaaatcaatgaatccaagagctgtttttttttaaagattaacaaaatagacagaccgctggccagactaataaagaagagagaagaatcaaatagacacaatgaaaaatgataaaagggagatcatcactgatcccacagaaatacaaactaccatcagagaatactacaaacacctctacacagataaactagaaaatctagaagaaatggataaattcctggacacatacaccctcccaagactaaagcaggaagaagtcgaatccctgaatagaccaataacaagctctgaaattgaggcagtaattaatagcctatcaaccaaaaaacatcaaggatcagacggattcacggccatattctaccagaggtacaaagaggagctggtaccattccttctgaaactattgcaaacaatagaaaaagagggactcctccctaactcgttttataaggactgcatcatcctgataccaaaacctggaagagacacaataaaaaaaggaaatttcagaccaatatccatgatgaacatcaatccaaatatcctcaataaaattctggcaaaccaaatccagtagcacatcaaaaagcttttctaccacgatcaagtaggattcaaccctgggatgcaaggctggttcaacatacacaaatcaattaacgtaatccatcacataaacagaaccaatgacaaaaaccacatgattatctcaatagatgcagaaaagacctttgataaaattcaacacctcttcatgctaaaaactctgaataaacttggtagtgatggaacatatcgcaaaataataagagctatttatgacaatcccacagacaatatcacactgaatgggcaaaagctggaagtatttcctttgaaaattggcacaagacaaggatgccctctctcaccactcctattcaacatagtattggaagttccggccagggcaatcaggcaagagaaataaagggtattcaaataggaaaagaggaagtcaaattgtctctgtttgcatatgacatgattgtatatttagaaaaccccattgtctcagccccaaattttcttaagctaataggcaacttcagcaaagtctgaggatacaaaatcagtgtgtaaaaatcataagcattcctatacaccaataacaaacagagagccaaatcatgagtgaactcccattcacaattgctactaagggaataaaatacctaggaatacaacttaaaagggatgtgaaggacctcttcaaggagagttacaaaccactcttcaaggaaataagaggggacacaaacaaatggaaaaacattccatgctcatgaataggaagaatcaatatcgtcaaaatggccatactgccaaaaggaatttacagattcaatgctatccccatcaagctaccactgactttcttcacagaattagaaaaatctactttaaatttcatgtggaacccaggaacagcccatacagccaagacaatcctaagcaaaaagaacaaagctggaggcatcatactacctgaattcaagctatgctacaaggctacagtaacgaaaacagcatggtattagtaccaaaacagatatatagaccgatggaatagaacaaagccctcagaaataacgccacacatcaacagccatctgatctttgacaaacctgacaaaaacaagcaatggggaaaagattccctatttaataaatggtgtttggaaaactggctagccatatgcagaaaactgaagctggactccttccttacactttatgcaaaaactaactcaagatgaattaaagtcttaaatgtaagacctaaaaccataaaaaccttagaagaaaacctaggcaataccattcatgacataggcacgggcaaagacttcctgactaaaacaccaaaagcaatggcaacaaaagccaaaattgacaaatgggatctaatcaaactaaagagctttctgcacagaaaaagaaattatcacaagagtgaacaggcaacctacagaatgggagaaaatttttgcaatctacccatatgacaaagggctaatatccagaatctacaaagaacttaaatttacaggaaaaaaacaaacaaccccatcaaaaagtgggtgaaggatatgaacagacacttctcaaaagaagacatttatgcagcaacaaacatatgaaaaaaagctcatcaccaccagtcattagagaaatgcaaatcaaaaccacagtgaaataccatctaatgccattcagaatggcgatcattaaaaagtcaggaaacaacagatactggagaggatgtggagaaacaggaatgcttttacactgttggtaggagtgtaaattagttcaaccattgtggaagacagtgtggtaattcctcaaggatctagaactagaaataccatttgaccaagcaatcccattactgggtatatagacaaaggattacaaatcattttactataaagacacatgcacacttatgtttactgcagcactgtttacaatagcaaagacttggaaccaatccaaatgcccatcaatgatagactggataaagaaaatgtggcacacatacaccatggaatactatgcagccataaaaaggatgagttcatgtcctctgcaggacatggatgaagctggaaaccatcattctcagcaaactaacacaggaacagaaaactaaacactgcatgttctcactcataagtaggagttgaacaatgagaacacatggacacagggaggggaacatcacacactggggcctgtcaggggctggggggctaggggagggatagcattaggacaaatacctaatgtagatgacaggttgatgggtgcagcaaaccaccatggcatgtgtataactatgtaacaaacgtgcacattctgcacatgtatctcagaacttaaaaaaaaaaaaaagactgtggcttcagtgttgtgttgagtctcctgtcttgtcatgtgtagccctatggagactcatgggaaggaattgaagcctcctgcaaatatgtctgcgtgtgagcttgaaaacatactccaaatacttctgagactgcatccctaaccaacagtttgtaacctcatgggagacccctggccagaacaacccagctaagctgctcctgtatttccaaccctcaaaaactgggagtgataatagatgttgttctaagttgctcaactttaggatcttttgttacaaagtaatacagataactaacatatacagtaatctacccaagatgacattgctagaagtggcagagttcaagccacttccaacatacttgctgttaggaaagaaggagagggcatgaaaggaaccaagaaaaataactcagaatatttccccactgctgttaatgaaaagagaaataaaagggcaaacatactggcttcccatctgctcctcctcccaaatcttacagaaaacactttgccatctttctttcccatcagtatcttgttctgaaatatataaaatacctgtcaagcaaaagcctttttaaaaagggttgatttcatcaatctggctgtctactttctttcttttttttttttttttgagacgaagtctcgctctgtcgcccaggctggagtgcagtggcgggatctcagctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaggctgtctactttcaaatcacaactgaaatccccagaacagtggttctcaaactatggtacctggaacagcggcatcagtattggcctgaagctagtgacaactgcacattttgcgtccccaccccgggctactaaattggaatctctaaaggtggggctgaagaatctgtgttctaaagggctttccaggggattcttatgcacactgctctagatttaagactcctgtgaaaatgacagtggctgtcctagagctttgttcctactgatggctgaaagtgtttttcagatatgaccaaagactttgggtggccttcagcctaatcaaaatatttagagatttaattactaaatgccaacccatacaaatgtaaagatttttcctacagagactttgtggtgaactgaatgcattttttaatcaactgcttggcaagcagtatgagttttcttgtttgtaaacatctatactaatgctaaacatatttattcacaacttgacaagaaatattgccctgtaattaatcatttcccagactgaattcagacaaaataaaaatgcactcctgaaatgtgcatccccttcacaattgtaagagtcacacacataaataatacaatcagctctccctatccatgggttctacatccatggattcaactaatcacggtataaaaatattcagaaacgaaaaaaaggacggttttgcctgtgcttaacatgtacagactttctttggtcatactccataaacaatacagtataacaactacttacatagcaagtacattgtatgaggtattacaagtaatctggagatgacttaaactataaaggaggatgtgtctaggttatatgcatatattgtatcatgttatatcagggacttgagcatgtgctgattttggtatctgcaagggagtctggaaccaattccccaaggatattgaggaactaatgaaattagatctcggaccgccgggaggatggagttcagcgggcagcggagctgtctcagtctttgccgccgcgccggcgagcgcccctcgggaggcagcggctggaggagcggacgggccccgcggggcccgagggcaaggagcagccgcctgccttggcctcccaaagtgccgagattgcagcctctgcccggccgccaccccgtctgggaagtgaggagtgtctgtgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcctggccgcccatcgtctgagatgtggggagcgcctctgccccgccgccccatctgggatgtgaggagcgcctctgcccggccgagaccccgtctgggaggtgaggagcatctctgcccggccgccccgtctgagaagtgaggagaccctctgcctggcaaccactccgtctgagaagtgaggagcccctccgcccggcagctgccccgtctgagaagtgaggagcctctccacccggcagccaccccatctgggaagtgaggagcgtctccgcccggcagccaccccgtccgggagggaggtgggggggggtcagccccccgcccggccagccgccccatccgggagggaggtgggggggtcagccccccgcctggccagccgccccgtccgggagggaggtggaggggtcagccccccgcctggccagccgcgccgtccgggagggaggtgggggggtcagccccccgcctggccagccgtgccgtccgggagggaggtgggggagtcagccccccgcccggccagccgccccgtccgggaggtgaggggcgcctctgcccggccgcccctactgggaagtgaggagcccctcagcccggccagccaccccgtccaggagggagatgggggggtcagccctcccacccggccagccgccccgtctgggagggaggtgggggggttagccccccgcctggccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcaacccccccgcccggccagccgccccgtccgggaggtgaggggcgcctctgcccggccacccctactgggaagtgaggagcccctctgcccggccagccgccctgtccgggagggaggtgggggtgtcagtcccccgcccggccagccgccccgtctgggagggaggtggggggggtcagcccccctgcccggccagccgccccgtctgggaggtgaggggcgcctctgcccagccgcccctactgggaagtgaggagcccctctgcccggccagccgccccgtccgggagggaggtgggggtgtcagtcccccgcccggccagccgccccgtccgggagggaggtggggggggtcagcccccctgcccggccagccgccccgtctgggaggtgaggggcacctctgcccagccgcccctactgggaagtgaggagcccctctgcccggccagccgccccgtctgggagggaggttggggggtcagccccccgcccggccagccgccccgtccgggaggtgaggggcgcctctgcccggccccccctactgggaagtgaggagcccctctgcccggccaccaccccgtctgggaggtgagcccaaccgctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaagaaaatgaaagctgcaatagaaactcataaatgaaaaaattatctcctgaccatttttgagagaatgagagacatattctgctcagtgtaaaagtggttattaaagttattttgaaaaatttcatttaaaaaaaaaaaaaatgtcatagaaggaggaactggttattctcaactgcagcgacaagttctgtgctaatgagtaactttcttcaaaatggggtgatttcttagtatagcagactacacagacataatcagatgtgacctatcccttcagccatagttcatccttgttaagaatatgtttattcaaccttgaggaggttgggatgatgcctaagagaagaaccaacttaggcttctagacggacctatcgggagacctgttccaagtaccaataatgtctcttcttcaaagatgtgggcattggtgacccactattagagattttatacaagttttggggctatcagggaccttagagatcgtctagtctggattcaaacattaatccaggtatcccatcctcaaagattgccagggagctgcataagcttcccaggtgatgtcaatgcgcagctggatttggaagtgaatgcctaagtaaaaaggataatttaggcaatcacttcaaggttcatccttggaaagtggattgtttctactttttggctgttatgaataatgctgctataaacatttgtatataaaaaaaaaaaaaaaaaaaaagaaattagatctctccggtatctaaatatgtacatatgtacatttttttttttttttttttttttttttttttgagatagagtctcgctctgtcactcaggctggaatgcagttgtatgatctccgctaactgcaacctccacctcccgggttcagggattctcctgcctcaccctcccgagtagctgggactacaggcgcctgccaccacgcctggctaatttctttttttttttttagtagagatgggatttcaccatattggccaggctggtcttgaactcctgacgttgtgatgtgcccgcctcggcctcccaaagtgcctggattacaggcgtaagctattgcacccagccatgtgcaggtctttttaggcaaaacaatgccaggcactcaaagaatgttggtcattaaaagggtatttcacttttagaaaaatatataactacacactttattcactataatcactattcactttattttaaattgtgacatattaaaaaaagattatctattaattgcatacttccattaatgtaatccttaataagatgcaaatttttaaataatcctttatgtttgaggaagaaaatggttaaaaatcaaaaaaggttaacattagttttttgaaacaggttaaaatcatcactagtaattagctgatgaaaattcattgttctctggttcactagttttatttaagtgtgttgtcaaaatgcagatgttaacaggaatcacctactgaaaaacatgctaaaattcaaggtcaataaaactgagttaattttaaaaaatcattttacctactaacatctaggatttctacctcatttctcaactgtaataatactagaagtaccataaaatactataattaaatacaaaattgactataaagttgaaccccaacaatgagagggaatgtcttaacaagtcattaccaaaaagtgactgtttaaatatagaaaatatgattttataagtgtaggaatgagtttttttcctaccatcttttcaatattcattgagcagttattacatggcaggcattgggatagatgcaggtagctacaaaaatcagtacaactctgatttgattatgcccacaatctgggggtacagaaatggaaaaatgtgtgtcatggagggcaggagaaatgcagaatacaatacactgaatggatacagaaaacaggaacaagatacttcaggaggaagctttgactcccacaacagaagtattgggtaattaatgaactatattccaaatcaacatatttgccaatggaaaagaaagttcataaaaacttgaaaaaatttgtcccattttatttatttattgagacaattattaatgcatttatttattgagacggagtcttgctctgtagcccaggatggagtgcagtggtgcaatctcagctcactgcaacctctgctcccgggttcaagtgattctcatgtctcagcctcctgagtagctgggattatagacatgtgccaccatggccggctaatttttgtatttttagtagagacagggttttgccatgttggccaggctggtctcaaactcctgacctcaggtgatccgcctgcctaggcctcccaaagtgctgggattacaagcatgacccaccgcacccggctgagaaaatctgtttcaaaaagtagataacaattaaaatattaatatgttgctttagccgttttacttctaacaatttatcagaaatacaaaagttcataaggatatatagatgatattcactggatgaaaaaaatccccaaaaaactatgaataacttaatagccatcaagatgggacttggtaatacattatcattcattttatggaatgcagtcataaaaatgaatgaaatagtttcatttgtattaacataaaaatctaagacctattaggtaaaaatgtaagtcacagaatacatatatgatgggtccatttatttaaagaacaaattaggagacatgtaaacatatcagaaggggaacagagaagagtcacacttaaattctgactctgtagcccaggctggagtgcaatggtgcaatctcagctcactgcaacctctgctcccgggttcaagtgattctcatgcctcagcctcctgagtagctgggattacagacatgtgccaccatacccagctaatttttgtatttttagtagagacagggttttgccatgttggccaggctggtctcaaattcccgacctcaggagtacctgagataccagctactttttgtttcaaaaagtagataacaattaaaatattaatatgttgctttagcagttttacttctaacaatttatcagaaatatgaaagttcataaggacatatagctggtactaggaaacaatacacttttacaatgtttaaactgcatgaaaaaacactatttctgaatcaagtgtaaaaaaggtttttttttcttttcttttagtgggtaaagtctagttattctgactgcttatcattattactgttgattctggtagtgaaaaaaaacttttgaattccattgagatagtaatgaacacagaattgtaacaatagacagatggaagtaatataaaaacactgttgaatttgaatatttcttgcttttttgctttcacagaaacacattattttacatttactttatataagtgaggtattttatggtgttttctaaattctattaagaacattctaaaaagaaaaggtgactgtgacagacagattaaaatccaatccacaggcagtcccctttggcaaaccactctgattaagtggctctattttatttcaagaatatatatctcttgcccctttaggaaatatgtgaatgttttccaaaagcaagtaaagagtgccacatcttaagcactagaaagcctatgagctttatctgggatctttgctttcataggcttgtgaagaaaatctgaacatgcagacaggcagtcactgtcacatattgaagtttaacagtgactagaggaactataaaagcccaaaactctatattcattctgcagtcatacaaagagcagagggtgaataatttaacttccaaaacaattagtccagtcctttacttcaaattcttcaataatcctccttttcctatagcagtcatcagacatgtacataatacctctgccttttttttttttaccacaacagtgcacactatctgtttgctatttgctgaatattttatttttattttattttatttttgagtcatagtctcactctgttgcccaggctggggtgcagtggcgtgacctcgctcactggagcttctacctcccaggttcaagcaatcctcacgctcagccccctgagtagctgggactacaggtgtgtgccaccatgcccagctaatttgtgtatttttagtagagatgtggttttgccatgttggccaggctgatcttgaactcctggcctcaagtgatccacctgcatggcctccaaaagtgatgggattacaggcatgagacactgcactcggccatgctgaatattttaaagcttaaatacattatttgaaaagagaacagtatcactatcaatacgaaaaataacatattaattcctataaattgaagataataaaatacaaaaaaacagtattttttttaaaattaactaattaatttagagacagggtcttgctctgttgcccaggctgaagtgcagtggcataatcatagcttactgcagccttgaactcctgggctcaagcaatcctctcgccttatcttccccagtagctaggacaacagacacgtgccaccacacctggctaacttttaaatatttttttgagatgaggttttgctatgattcccaggctgatctcgaacacctgggctgaagcgatcctgtcacctcagcctcctgagtggctgaaattacaggctcaagctaccaaacctgggaaaatgtacaatagttttattaaattgtaactagatacaggctgccagtggctctgagccaaagcaaagtgtttaagccatattggcaccaagagactttcttgagattttctggaattgaaaaagaactaaagagggaatacactttctcaattttccccaatactgtattgtgaaaattttcaagtatacagagaagttgaaaaaaattgaacagtgaacacctatatgcccatcatctagatactatcatctggcatttgctgtatttcctttttcagacatcatctttctatccattcctctatggagaaatcaaggctatttaatttaatattgttatttaactacctagagggagttctctcaagaatcaccaggtcccaatccacaattttggaaagactattgtaaaagataacaacatcatttcccaggccttggcccatcccagaaggcttgctactgtatctggcccatggctatctttcttccttatctctagtccctaacacataagtgcaaaactaaactaactctgcttgccataaaatgccattcacaacctggccctaattcacttctttggcctcatggtatgtccatcaggtagcgtttattgagcgcttactctgtgctaggccttgtcctaggaatttcacttgcttatctcataaaacccttaaaacagttctatgaggaaggtcttccttcctattattcccaatttataggtgaccaagtgatagcagtgtcttataactgaacaactcaacacactgtccaatttttgcagtggcctccactcagcccatgtacatttcttctaacacctttcacaattctaaatctgtagttttggctgcttgaatacatttcctacacttccttcatccaaactttactcatctgtttagacctaactcaaatgccacctcctccatgagacatgctcaagtattttaagaattaaataaatgaatcgatatttgcaaggtcaaaatgtacatttgataaactaactgaaatattaggtcttcgttttcgtaagtaagtcttaagacaaccaaaatgagactatttctcacgtacagttgtcagaaaagagtgacaaaacaaaaatcaaccagatgttaaataatcctcaagggaggtacaccaccatgtttaggctaggtacaggcaaattcacattttgttgtcctagcagttatctcttttctggtgtcttgagttcttcagctcaatcatcaatggaaggatattctaccacaatgactattttcatagatacaaattttcatcccctttcttatactttttacttctggtgggggtggggcggcaattatagttggagttaattttaaaagatggtaaatatctcagaatgtctgtaatataattacttttgaaataagggatcactgatttatacagccttaaagtttgaatggactttaaagataatataatctatgatgtagtggtacaagggaagaggggggctggggaagaacctgatgtgtagtgtttgccaatttccatagcccaaccccgtcaatgaaagcatgagtattctgaggaccaggataactgaaagagttgttgaaggtaacagaaaaatgtgtgagcatctgcattagaagccaggttaactgactccatgtaatctattcattgtcaactccctagaatcatctaggaattgtggaaagatactttgccaagcctcacaccagagtaataaaaaaataacttctggtgattaactcctctccagaaatacaaatacaaataaaaaacaaaaactctctatgtgcttctaaaatatctaagttccagaactcccataattcttttccccaattttatgttgcctagtaagaaaatctcatccctttatattaacttggggaatgaataaaacatacattaataaaaagcataagttatcataatatttttaaaggttgtaagtttcaagtattttccatgtgtggccatgaattatgcctattgaaatattttctaaaaatttgggcctgcttttacaaagacgagactggtttgtaattagtgcattgattttatgtgaatgagtgcttttgaggtgcttaatgagccagtaatgattaatacttttaacagactaagaatacttttacttctattagtttctttattaaaccctttctaatatgtagaaaacaggtaagtttcagttagtagctcaagttaccacaaattccttgtcaaatttactaaacaatccacatccagtttagctcttcctcccttcccactcttcctcctttccgcccttccctctcaaatatttattgagcatctagcaagtagattactaaatccaacccaagacactcccctgcatcagagataacatctaataaattcctctaattgtcattctgtgactgaaattgtattcaggaccgcatttctaaattatagttcaattagtagctttgtttacaagtcatgaataccattttaattttgcagatcttggtaacacatataagaatcttctagccattgcactgccttttgaaactgcataatctcgcacgttttaaaggagcctctggtattattttcttttcaatgtaatcatagatgaaggtctaaagtagaccttcccattctctttctgaactcctttaagttctttaattataaccctgaaatgcatctcttttgcgtgcccaacatcttcagcatatttctcttctttaccctgcagctgattagcaaggactacaacactgaatatcaaatattatgatttttgagttatatgagcattttccttttcacaggaataatatgaagaaaattacctcagtacattcagacttcttttttttttatgagtattttcttttaattcttattgatagtctaaaacaaaacaccattaactggatagtttataaacaacagaaatttatttctcacagttctggagtctgaaagatcacaatccaggcaccaacagatttgatgtctggtgagggcctgtttcctggattacaggtggtgccaccttcttgctgtgtcctcacatggcagaaggaatgaaggagctcccttgggcctatttcataaggacactaatcacattcatgagagcccaccctcatgagctaatcaactgctaaaggccccacttcctaatatcatcaccttgagggttaggatttcaacttacgaatggtggggagaggggcacaaacattcagaacacaacaaaattatttagcatgaatatatatatgtattgccttactggttaccaggctacaaatcaggaagtaagaaaacaatcttccaatgcagttattttcaagtagtgggaaactcttgatattccttaatagaggggccacatcaagcctttggctcccaagaaggcaatgcctcttgaaaactactgtgttcactggtcacatgtgtatcagttacaaatgtgaccatccagttgaaacataattctagctgtgtatgccagaaatatatctagatataaccagaatgccacgatgtacttgggcaaacccccaaggttgtcgttgtcgtgcattttgtgtgtgtgtatgtgtgtgcaaatggcttaaatattccattactgcctattgttcttacataaaacttttcaagaaaattagaagttaataggctgactgatgacagccttatatcaatataaattgcttaaaatattcttaggcctaagtggatgtaaatttttatgttcattcccaatgttggataagaagttgacagagctgcacaaaaattgcaaaagaaacattctaaatcatgagctctttaagtacagggacgagggacgacatcttacccatttatatatctccaggatttggaacagtagctggtatatagagtaattgttgaataaataatatgaaaaattggtttgagatccaggaacagagtaaaggatagggttgtggtcgcactggtggttacaaggcaatacttttttacctttcaaactaagaaaaacatcaaatatataaaaaaaaaatagaaggtgaaataattatacagcctacccatgtatcctctacctacctttagtagtatttaacgatttgccatatttgctttctccctctcttcctctctatatctatctctatagagatatatgtagctatacatatatagatagatggatagttgttgaagcatttcatactgagtggcctacatcatgacacttcactcccaaatgcatctcctaaaaataggaacattgtcctaatcacactacaacatgtaagaaaatgggccgggcgtggtggctcatgcctgtaatcccaacactttgggaggccaaggcgggtggatcacaaggtcaggagatcgagaccatcctggctaacaaagtgaaaccccatctctactaaaaatacaaaaaattagccgggcatggtagtgggcacctatagtcgcagctacttgagagactgaggcaggagaatggcgtgaacctgggaggtggagcttgtagtgagcagagatggcgccactgcactccagcctgggcgacagagtgagactccgtctcaaaaaaaaaaaaaaaaaaaagaaaatgaacaattcccctattgtcatctaatatgcagcctgcagtgaaatattcccagttatcccaagaatgttttatagacacacatacccaaagcagtatccattcaaagttcacacattgcatgtagttcttagggtctatttcacatattcagtgttttagatttacttatttcaagttttctatttctatatatattttagtccatttgtccctgaattgtagcaagtattttcaaatccataacttgaaactgagctttgtggattaaggcaaaaaggacattgtagatgcctctggcccatcctcctcacactttgagtaagtgagggtcttctggtccatcctcctgcacatcaggcgttatttcactcttgacatacacttgtgatgtggggcataaatcaccataagcatctttcatgtttgcctaaccaactcagtttaaatcccatgactaaaaagggagcctactttccagaatcagactggaggaaaagaggagattttaaatttcttcctgctcctaaaaatggaatgcttgaaagtgatatatactggcaatgtaaaatagttttgatggggagagaatgcagaaattaactttctaacttaaacaatttcaattttgtaattctcaatgttagcacaaacactataatcaaaattcactgtactgtgctctaggtactgggtggaggaaaaaaaaaacactgatgggacaaagatcttcttagggaatatggcagagaaagtgaaaaagcatgaggaataaagattttcaaatatgggtatctgaaagggtaggcctttccattttgttctactacccagtgtttcaatcccggcaagaacaccacaatattccaggtctttacctccatcaccctgccctaaggatatgtggggtaaggggcactgttgtgcccaaggctcttcaaatttaacgtattattaccactgttattatatttaattctaccactggaagtagtaagacctcaatcaggggtgattcactcccatgatattgatcagtataaggcagagactattgggataccaagtgttaattcttctttcattagtggcagtatctcaacagaatgtcaattttataatatttttcagcatccctttcaacctggaatcatgtgattgctgtctgggtagtgaggtgggacttccgggattcagcctggccttcctcctcccttgatacatgaatatcttaaattatactgcataggactctcttcctttattaccaatcaaataaaaaattaattgggtcaaaaatatatggcccattatatgcaagggctataacataggcaggtcttagggaatatcagcaaagcgaaaggaaaaaataggtccctctatggagaaaatcaatgctcctcaaatgtaactgaaaaacatgtttgtctattcaatcccggtataagccctcattggaagatttactggaacacactgaattgaatatagatagtaaaggaagatgtagctgataataggaacagagttgccctgtgatccatggtatgtgagggcatagggaaaaacacattcaactcaaacaagggtatggtaatttcaggcttcattagaaacacagcgaggtgaaatcaattgtaagccagacaggaaagaatcaaaatcagttagaaaagaaattttaatttcaagcttctaaggagaaactataaataatgcaaggtttaaaacatattagcaaaaatacatcacggtatctctctcaagcaaaacagctaaacttgaaactttcttgaggatattcagctctgaatatttaaaagcaaatgcacatatttgccagagagaaaaacatgtttagggggaaaatattaaaatgaagtctgggatgatacacaccaaaatatgaatgtggacataaacaactccaggttattttccttttcttctttatacctttatgtagtttttgaaaattttaaattatgaatgcataatttttgtaattagacagataaagagctttagcaaaaagaaaaacattcaagtcatcatataataacattgtatgaacattagacatggaaggctcatcacaagcaaaccccaaatatcctccataagacaatctaatgacttgctcttaatgaaagaatggtccttcctctctccaatctccatttttgggtgctgctaatggttaagacctgtgcctctgagtttgtagactctagtatggttctccagatcttcagcattaaatgtatccggaaacaggtaagcaatcagttcaaaagaaaagaacagattttcaatttccttctcctaaaaatgtcatgctctaaagtgatacatggaaatgtaaaacaattttggtgggaaacatgtgcagaaattaactttataacttgaataatatcaattttatgattctcaatgttacaattattagaagtacagaatctctgtccctaactcagacctgcttgaattggggaattggggaacttattggggaattactgattaaaggaatttattctaccctcctacttacagaagatgcccgaggaaaactgtggatagtggtgttatttaaactaagagatacagaaataaaattatttcattttttaaaactatataaattgttttccatctatatctacttataacaacaaaagaacaaaagcagcttttttttttttttttttttttttttagctgtttttactcctaaaacagctaccactactattactactatactgcaagagagcaataacatttatgggacctttaccatgcatgagacacagtggtacatgcttgggatagtccattacaatggtgttctataatgaaccttgtcaacgtttataaatgcccttgcatagtcccttccctttggatcctggctgagtctgtgacttgctttagtcctgaaaatgtggcagcagagatgctgaaccagtttcaggccaatgccttgagaaggcttgggagtctctgcctttgccctctcagatgcttaagggccacatagggaggctggttactttgctgaaggggccctttggagatatcacatggagacagaggggccttcaacaactggggatgagggaagaggcccgccttcccagaacctgccagctgaatgcagtcacacgaatgaacactgacaagaacagtggaagaatggcctacctaaccccaggccagattgctaaatcataagaaaatggttctatcaagttttggggtggtttgctatgcagaaataataaccaaaacagtgctttatagacatttgactcattttaatctcacaacaaccctaagaaataggcactaataatatcatccttctacagaagcatttatccaatttgaataacgcctcctataataagtcgagggggtagggctttactgcatgagaacaattctgtatattatcaaacacacagcagttccatttctcatctgagggtggggcatttcctattactgactgtgtctcatcatctctaaagtaaagagagtcaataactcactgaacgtctaagattcttttcagctctgaaattccatgactctaaatgagtagccggtgcttattgtttatacagtggttttcaacacatcacatcacacacactagcaaaggtcggaggggaaaaaagcaccttgagaacatcccatcccaactgcccaggccatctgagtaacaggaaccaccccaccagtcaggaagagacggctgaatgcatattaaaacactccaagtatgctgcccttctggaatatcgttaaacaactcagtctgtcatatggtcctttgagtttttcaattaaaaaagaaatggcaaatgtaaatattaccatctctttttcagtctgctaatttgtgttcaggaaagtcttccaacaagaaaaacacatggttaatcacctttgagacccaatataacaaagtagcctggaaagagaaaaggggcttttttatgatttaaattgttatgtggtcaatcaaatctaatctattctaattcattcacatggaaggtcaattatccaaatgctcttaattcaacctgcctctgatcttggtgaccagtgaaccattcaaagggcagctgttttgtgtgtgtgtgttttaatatgaattcgttatcacagttttacgttttcctcattctcaactatttaagctaacgtggcctgcttgacgaagcacatttaagtagagggaaacacacttagttctctttgtattctgaaataacaacattctctatgacctttctggagtcaatgtacacagaaaacccacaagattcatgctatcaccaactgttggaaggaaaacaccaggcaggcagcaaatctacttcccaggccaattaccccattccctaaaactattccatcttcaaaacaagcctaaaatgcatgtcaagaaaaacatccatgtgtctttctttactctttttatgaaggcttttgcttggtgatttgctcaagggtcaagtttaaatttgggtcagtttgtttatttgtgatataatgaaaaagaaatttaccagggaagaacagaactattggaagtactccatggtaaatgagagaaagtatgccaaagctcttcgcaccaagactaaataaattagttgagaattgtatttggatgctaggaacaaagaaataaatataaggacttaaacatacaaggatttattctcttacataaaggaacactggtggtagataggcctgggatggtaggatgctaccaggagtccatcaggaactcagatgcctttggtttgtctcctctaccatgcaatggtaccgttctaaggttatttctcagtctaagagggctgctggagcccctgccattgtaaagtcattccaagcaacagtgaggagcagggaaaagggctcccttcccagctgcttcagcttcttaaacacagccttgccagaggtcccacattacacttttgtttacatatcactggccagaaagcagtgacgtgattccacccagctgaaagggaggtggaacaatatcatagaattgacattttgttgagattctactattaaggaagaaaaaaaaattgatattggatatctcagtaggccctgccttataccaattaatttcttggtagtaaatcactactgattgaagtcttattatttccagtagtagaagtgtagctaagaataataacagtggtaataacaccttaaatctgaaaaacttctatgtaaaagttacaatctggttcacacaataatcacatgatagtacaataaaagtgacaataataatgatagcagaaattaacagcagtatctgtcatttattaaacaccaaattctgtgctgagtgctataataccttattctcatcaatcttcacatcaactttgtgaggttttcattaactccattttatgaagacatggacttcagagatgggaagtgacttttctaaggtcatacacttcaggagggaaacagaactgcaattccatcaaagccctcttgatcacactggtgttaatcattcccctgatgaggtcattaatatcacattttacagctgaggaaactgaggtccaaattatcggagtgctttaattcactgtaatattgaatcaatggtaggacttttattataaaaatcctaacagggccagaaaaggacttaggaaatctagcttctcatcctcgctctatactttaatactgattttgatctgatagtaaaaacaatacaggcccactgggaaggaaaaattaaaactatacagtaaagaagagagtaaaaaatcattcccaacactaccagttggagaaaatataggcaatgcaaacattctagtgagcattctctggggtttatctgataagatataaagaaggggaggggaagtggagagacagaggttccataatttgtctaacgtctctgcactacagagccagcactcaggttcactgcccaagtgcccagtgtactctctgacccaagacattcatgagtcgtacctttcctgctgaaagacattccaattacatgcaggatttaaaactctatgacaagggactgctctttctttttatgagtttttaagaaaatgccttttaaaatttctcttccaagctctgagataaagaaaactgaaatacgaccattaacaatttacccacagcatgcatgagtttaacgctccaaacgatactcagggttctcaacattaacagtgcattgaagccaactcatttctcattttctgttgccaactccataaatctgcttgaagtcttgaaagtatagattatatatttaagtgattcttgtattctggcaagtaaaaacataaaatgtaattcgaattccatataacggtattggaagaagcacaaagatggcattctgagggggaaggggtttgtgcatttaatattttcggaatcatatattatgtatcaggtactgggaaaacagagatcaatcagaaaaggaggaccttccatctagtactagtactagtactagaattttcatctagtatctaggggtccccaacctggaaactagtgtcattttaggctggaaaatgccttgttatggtgagctgtttgtgtgctgttgaacagcatccctgacctcttcctgccagatgctagtagcatacccactccaaaatgacaataataaatgtctctagacattgccaaatgtcccctgggaggtagcatggcccccagctgagaacagctgatctggtccatcccgccccagttcacagaacctgggaagatttccaaggagaaagggataacaggcaggcaaagtgaggagggagaggaagaacattctgggagaagggtctctggaacagatggtagagatcatgccagcaaggggaggtaaggtcatgcggggccggatgatacaagcttctgaatctctgactcagaaattcagaatttagtttgcaggaaatggggattgtggtattattttacatatatatatgtatgtttttgtccacagttcctagctcataactcccacagctcctgttacagccttttgttataatgttggggcactttaggtctcagaagcaaacctcaaaaaacaatctctctctctctctctctgaaattctcctgccttcctttcacctgctcctttttcttcccacagcaggctttagaaactaaaaatatactctaatctccccccacttttctgattatgggtcattagaccctcatttccgaaggggtcctgtgtcatacctcagaagaaggaatgctgcacagagaggccaagaagcatctgtatagacaggcctttctgggtgttcccactcagtctactagcattagatcataccctttttgtctagtcacatttcaaaatggctgtcaatcatgcccatccaatggactctccataaaaggtccaagaggatggcgttcaggagcttctggacggctgaatgcatggaggtttctgtagggcggcatgcccaggaacgggctagaggctctgagccccttcccataccacaccctattcatttctttatctgtatcttctgtaacatcctttataataaaccagtaagcataagttagtatttacctgagttttgtgtgccaccccagcaaatgaattgaacccaaggaagaggtcatgggaaacccaatttatagccggttggtgagaaacacaggtaaaacaacctggagcttgcaatcagcatcggaagtgaggcgtggttttgtgggactgagccctcaacctgtgggatctgagattatctccaggtggagtgtcagaactgaatttagatagaggatgcccagctagtgtctgctgcagaattgattgcttgcttactggtggggaaaaccccccacacatttgatcacagaagtcttctgtgttgactattgtggtgtgaaaatagagaaaatacagtttgtgttcttccattcagggatcaagtttgtgggcagaaactgcagtaaaatgcacaaaaagcaagtcctatgagttgagtgtgaccgtgtgctgctgccatttgattgctttaattaaagaaaaataggggatgaagtaattacaggccctctctgagactgtcttcttaacaaggtggctgaatgtcattgaaaattttctggattttaaaacagaaatacactgacacagagaaaatattctgcacattgcctgacacacagagtaccctcaccaatgttaattccttattattaccattcttgttgctggctgtcttaaagcagggtggggcactgatggctgatgtcagcatttctcagtatggcccaaggaaccctggtgccttggaagtgttaataatatctgtacatacatacagatgtgcagacacagagaatcattttctttcagaaatttatcttttaaaaaggaaactatgacaaaggatgtagaataacagaaacatttatctttatatattttgttataaatgcttacctaatttatactttcttaataaataaggagaagagtatctaaataaaatgttttcttgaattaatttgtttatggggccatgcttttcctgttctctctcaagagttcctgttggtaccccacttatatttaatttagatactgttagcctggaaaatattgccctaatccagttgactggggttgtatggaaaaggccctggctttggtaaccagagattatgccagggccgggggccgtcttgaaataaagagaaagaaagtgtcatcctgtgaaaaggtcaaggaggaagccatctcaacagctgtttgcaaacctcacttcaaggcaaccaactgacagagggagaaataatctcaaggaggtatgaaaacagcagcagggctagggaaacacatctgtgaatgcccagataattgagcatcattgtttaggagttggagggccatctctttctgtgcatttgaagcaattttctcttgtgacatactatgttttgtgttcccgaacatttaacctctggatttggacagcagagacctggcccaagcccattccttttaggagtcctcaaatggttactgaaagtgacggttttctaattattctgtcaagcatcaatctcagaagttcccagttcctccatgctctgactgacagggcaatcagcactttacttaaagtataagcaccaacctcttctggacagcaagagcacctcacatgcccaaaaacagaaaaattcacagctctaagaaagtaagaagccctcatgggtgtgcaattttacaagcgtgtgtatgcatccttcctgggaatagcgctttttgatctggcatttctttcaaatgggacatccccaattccaaatttcaaccatcatggctatgattttacatactcactgtgctgctgaaaactcaatcaaaatgcacagcaaaaagccagtctcaaagatctccctcaatcaaggcagaccagagtggtcagaaaagaagcagatgtctacactccttcaactccaagtcaaaacttataattccactttcttacatgctactcttctgagagaaaaatgtgggcaaaaggaagcataggaactgtcacaacgagaaaatattcttattaatcacatttaggcaaattccatttatttgtttttctctaaaagtgacctccatatattaacagatgccctactttactttgtcttttagaaatcagttgcttgtaatctctgagacaatatatagaagtagaaatgagattggtggatcagtcttcaactggtttgaaggtgatggtaaaagtctatgaaagctgccagcatggtgctaaaactcaaagagggcatggcatagtgacatgggttatatgatgagtgagagctgccaggacgaatcggaagaggggcttgacaatcgattgcctgaaatacattacagggcaaaagaaagcagggcacctgtggttatgtccctgatataagaagatagccactgtatcttcaagatcccagaggcatggagaaaaagtaggtaattcaaatggaggcaatttggagacacctagactaataccattagtctccaactagtctctgttttctcttccttttccacaatgcgtactcctatctttgtctaagatttcattgttctggtgcttaaagcctttcagaggcttacaattttatccagaatgaattcaaacttcctgatttggcctgcaagtcctttcagagctgggcccagcttcactctcagcgcctcctcagtccttctcgctcactctgctctgaaacactcagagctctctcctgcctttgcttttccgctgctcttttcactttgccccaaatcaacaaggttcactcatttacatcattcgggtctccactcaaatgtcacctcctcagagaatccctctctggccaccccatctacagcaattgctgtctcactgctaaggtcctgagaatgcacctcacactctgaactgcaggcagcatgactggctgcactgggggcaaggctatgcttcccctgggctgctcccagccgagtaggggcatccaatcttccttccctctctccttcactcagagtcagacctgcatcatagtctgatggccaggccagcctctcctggctgctttctcattttctttcaaagggatttctgctgataaaatccttgcacatttaatcttgtcttgatggcatctgggaccctagcatatttattatcatcctgttttactatcttcttagtaccacagaaaattatctagtgtggcacccagcaatcagcattttccatgcccttcaggcagttctgggacatgctcaagtttgagaaacaatgacctattattatatggttaattatagtcagagcaagaatcaggacccagctgtaagaattcccattcatttctcaccaagcagtactcttttaatgacacacacagcccttacgttgtatctgcttaaataccctgctttaaaaaattggccaggcatggtggctcactcctgtaatctcagcactttgggaggctgaggcaggtggatcacctgaggtcaggagttcgagaccagcctggccaacatggtgaaactccgtctctatcgaaaatacaaaagttagccaggcatggtggcatatgcctgtaatccctgctactcaggaggctgaggcaagataattgcttgaacctgggaggtagaggttgcagtgagctgagatagtgccattgcactccagcctaggtgagagtgagactttgtctcaaaaaaaagaatttatgctggtcatatttttacatccatttaaaaagatggatttaataaaatgggcattaacatactaggtaaactgaaggaatttgtagaacactggtttgatcaaggctgactgcctccatctatctaactggctttgtagctttttaggcagtaaaaataaacttagtgtatcccctgtcttgtgagggaagcttaatctgatgttgtgctattactaacatggaaaagcagtcatgctatcaagatggcatccggcaagatgagatgacactgaagtttgtcgctatcgatttttatatggcaaaacctgggtcttgttctcccttttctccctttcgatcaagtactctcatctccaggaggaaatgctactgttttggtagacagtggctgcccagccacagtgcaagcaagtgtgataacgacaaaatggattgattactatcaggaaacgtatggacagtaaggtatgaaatattaccagctgaacaaccaagatacaaagatataacatgctttactgcttacaaagggaggcagccattaggaagtttgctttctcacataaatccttgactatctttccctggaggggaaaagtatattacatctagtccaatagaacatttagatacaagtcaggattctgacaagtaggaatatttaatttgttttgaattaagaattgagaatcggaacttccactatgatatgaatacagaaaccaagaccttccttactaattaatgacctctggcctataaagtcttcaggagaatttctaaatgttctctacaactttgtgttttctcttacctcttgagattgataatataaacacacctagatacacaataactatcctccgaaatcttttactatactagctacaatctctcatacatcaaaacagcagctctagtatatttttctcacctgaaatattgaggaataggaagttattcagtttctcacaattttcttaagctcaaagggtttggtcaaagcacacgtcatacctgcttaatctctagagagaacaactttgacaggtgaagcgagaaaaaagctgctccactgccttcacgtggaaaaaagatgaaatgtaaaggcctgcaatgacagacttttcaaatagggttttagtaaaagaatgatgtctttggaaacttaaactgcaattttaccttgaacaagtataggataggatatcctttaaagagattatttgaaaactataaaatatttattcattcaacaaatatctaataaatgactaccagatcagtataacaccataaccaagagttaatggaaatgaataataattaaatatgtaatatggtaggagacgtatatgttttatcctgtcatttaatactcatagcaaccctgctgagttgtttctattaatatacccatttcacaggcaggaaaaaaaaaatgagacttagaggagttaactcacttgggaaagtcacagatgtaagaggaaacagagcgggaattccaatcaaggcttactcatgtttttaactacatggtctaacaccaaactaagcaccctgaataatataatgcatgctgtcgagaaatgctattgtgaaaatgaataggagagaaaagagccataatacagatgcccaaatgagtgctacaagaggggcaaaagtgtgaaataaaagcaggccgggtggtgtcaaattctgtatgatgtgtgggttgaggaggtagagcagggagtctggcctctgaggaggcaaaaaaatcgaactcactcaaacttgttttctgagcgaatcttcaatttgtctaagacttttccctggagttaggaatttgccaaaaaattatcagcacctattaggtgccaatatagtatagacatggaccctgtcttcatgaagggcacagtctagcagaaaaagtagggcagctttcaaagatggtcctgtaatattttctgcttcacactcttctgcagtgcaactttgccattctcacattaagagatggggtctgtttctctaatccatccagctccttgaacctgggcaggacctgtaactgctctaacagaagatggcagaaatggcacactgtcagtcctggcctggaagtttccatttcctgcctcttgggagccattcactatatatgatcactctgagaccaccatgctatgaaaaggccaaactacacagagagatcagatggaatgtgaagagaaagaaaaagagatgggccaaggagcaatgagatgccaggcatatgaggaagccatcttgtgtgtccagcccaattgagtcatcacacggctcgggctccatccaccaatgactgcagctgcatagcagactccaagcaggggccactcagattagtcatgtgaacccactgaagcatgagaggtagtgataaactgctgtttttaagccactaagcttcggggtggtttattaaggaagcaatggataacggaaacagagctgaatacaaaattacctgtatgactacataatcaaacaagaaagagtataatttgagaaatcctaacgaggaacatgcccctgccttcaatcaggtgtaaggagtgcgtacaaggctctctgcataattacattcagctaagacctgaagagtaagctgaagaaagaaaaacatgagaagggaaagtctggagcagaaagaacagctcagtcgaagtcttgaagatggagatgccctcatacattctaggaagggagaaaagattagtaaccaaattaaagcagatgtataaaatgggcatgaggtaggctggcgagttgggcatgggctagctcatacagagttataagctgtggtaagcattttgagctgtatcccaaaagcagcgggagctaaacaaagggatggaagaaagatttgtggccactgtgactgtcatgagagattcaggagaaatcagtggggaacctaactggacataagttcttaaagatcaaggagaggataccctgaagggaaactcaacctttaccctaggcctcacatgactaggaagttcttagctatactttattttaaaataattttttttggctgggtgcggtggctcacgcctgtaattatagcactttgggaggctgaggcaggtggatcacgaggtcaggagttcgagaccagcctggccaacatggtgaaaccccgtctctactaaaaaatacaaaaattagctgggtgtggtggcatgtgcctgtagtcccaggtactcgggaggctgaggtgggaaaatcacttgaacccaggaggcggaggttgcagtgagacgagactgtaccactgcactccagcctgggtgacagaatgagactccgtctcaaactaataataataattttttaaaaaagattatggcccgggcacggtggctcacgcctataatcccagcactttgggaggctgaggcagccctatcacctgaggtcaggagttcgagaccagcctgaccaacatggtgaaaccccatctctactaaagatacataattagctgggtgtggtggtgcatgcctgtaatcccagctactcaggaggctgaggcaggggaatcacttgaacccaggaggtggaggttgcaaagtgccaagatcacgccattgcactccagcatgggcaacaagagtgaaactccatatcaaaaaaaaaaaaaaaaaaatgttgtccaaggaattaactttctcaattcaaactttacatctcatacaatgagtttaattgtatggtctatacataaatctgatctaattcagggaatagaatgtaactaactttaataaactaaaaaaaatgtaaaaaagaatgacacagttcaaatgagaaacttaaatcaacttttcacatttcatgtggtattctcaggcccaagttagccaaaaatgtgcacataatgagcttcttatacttcagcctctgctttattcctctgcttatttctctcgtatacttcagactgctgagtctgtaactgcattttcttatttacatgcttttctctacaatgatgcaatggtttgaatgtctcctcccaaactcatgtttaaatttaattgccattgtaacagtgttaagaggcagaacctttaaaaagtgattaggtcatgagggcatagccatcctcaaatggatgaatgtctttattgcaaaagttggttagctggagtgggctcctgataaaaagataagttcagcccccattttctctctgtctcatacactctcttgccttttcactttctgccatgggataatgtaacaagtaggccctaaccagatggttgagcaggtgctagcatcatgctcctggacctcccagcctctagaactgtaagccacataagtctcttttctttataaactacacagtctgtgctattttgttatagccgcagaaaatgagttaagataaatgcctcagagttctcagttgccaccacttagatagaaagatacccactgccatcctttctatccttgccctacaaaccaaacaggtgaaatgggggagctgctgctttttaagcacagctgttacagacctgaaataccccgttcttctgttatgcctgttaactgggagggtgatgggttacgcaaaaagggacactagagcaagaacccacaggagcactgcaaagagaaaaacttggagaagatagaaaatattgctaacactgttgggatcagagtggtgttcatttcaattttgtttccttttgtgtatcctctagataagaaagagttattggagaaatgattatttaaatcacattactggtgaattgagatggtattcaaatggcatttggccagagaaccctgggaagtctgaaggcttcagccgtgattatgaggctgccacacaagggtgatgagggaaataaatgtacaagcaaagtgaggctaggcaatatgacctctattatcagctgaggtgagagcatccaaatctttgtaagacagaataactgggttgagggcttctttacccagttaagttaatgacattaggacatcacacttgccttttcaacttccatgacccaactgcagcccctctaaattcaagctccttaacttaccactctattgaaaccagaaaacttcattcttctacagttacagggaaagtagccagagagaaagacagagaactctccagaaacggctaaaactggtctggtctaggctgacctagccttctctgggggagaatacaaaaaggtgtgggagagaaatgatgatgatgaagaagaagaaggcggcaaattaatttggccagttttaggggagaaccttggtctgtgttacccctcagccaggtcctgagggtagcagagaacggacaacatggctgggctctggatctcttaaccaaacccagcagctccactcaccaaggccaactaaatatgctttcatggagcaaaccacatccataactctcctcatccttgtagtagtttcgtgagaggtgagaaaacaagtagacacaaagaactgtttcctccagaggccacaatgtgattaaagaaaacatattagatatatgcatacaccttcctatgtttagagtccttaatgaccttgttttaagacaattattttcataaaattactaaaaataatttgatgttacattataaatggataaaatcactgaaaaaaaaatcaaatctagtttcatcttgatttcctactttgtccatccatgaagacatataaaatgagtccaataggaacaagcaaacaacttctttcttggactctaatttgaggcattgttaacacagtgatgttcatttattctatacatggaaaaggtgatgtctaaaaaattcacatgtccatattttactactgacttgtacattaaaaaatatttttttaaaaaacaagaccatgtttcctttcatgctggatgtgaatgaagtctgtagcaaccacaaagtgtcatgtgttagatctagattaggaatctggtaatcatagacatattacatgatatactggattttactctataatttttacattttatcacaatggctgttttctgggttatcttataatgaaatattcttgatgaaaataatttatttttacccaactgtcactattacacttagatttatttactttaattatatgcagaccctctgaagccatctgttaatgtctaaatatctattatacttgttaataggtttttatttaatatttgggatcatttagcaaaatgcattgttcagcagatgacagaagccaatcaatcttaattaactaaatggtcaccagaggactattttagggaaggatagcaaaaaataaaattcttccaacttgtaggtgtagggttaaaaaaacaaacattcaatgtagtcccatgtctccaaggcgggctggagtggggataatgatatacttcaaattccatttataaatgtatactactaaacgtatctaagatgatggtgacagcaaaaagacaggaaggcagctaagtatcttaaacatggggaaatgactaaaagtataagggtgtaatcatataatggaaaataaaatggccactaaaaatcttgtttcagaaaaatatttaatgatgtcataaaatgacttcagtatgttattaagtggaaaaaacagtatgatctagactttaatttttaaaaatatgcatttatacagaaatgaaaagaaaatactggaagtagataagtcaaattttaatagttgttatttctgagctaaggaattatggatgactttatttttatttattttttttgagacagggtcttactccagttgcccaggctggagtacactggtgtgatctcagcccactacagccttgacctcccggactaaggtgtttctcccacctagcttgatgactttatttgtgtacttttctgtattccaaatcctttgtaatgactattgtaaaggattacattatggagctcaattatttaggaaataaatccctcagacacttaattctgaaatttgtgattttttttttaaaagcaccagtgatgaagaatagaaattaacttagaattccaaaaagaatgagtattaaaaggtgtgttttagagactgttaaaaataaaaatcccttctgtaccaacctcccaggcaatcattaagagtcttttgactacacgatacaacacacattaagagtggatattgcacacttcattttagagggagttttatttgaattttgacccaacttcattttaaaatgatattttgtttggaaaagacttaaggctgttttctacagataacttccgagtagcagtaccaccagtctttaacttcccaaaacttgccaagtgcagcgataaaggtataaactgtgtttaattaaaaccacttgctttaagtaaatggagtaagagtttatcattcacatcacctcccaacttctcttatcatgccagctcagctcttctctgaaggaggctactgctgttatccttagtgatggaaaacgggtacaaggtcaacatcatcttcttgtggtcactgagtttaaagaatacactaacaggtcaggcatggtggctcacgactgtaatcccagcactttgggaggccaaggcaggatgatcacgaggtcaggagatcaagaccatccttgctaacacggtgaaacccgtctttactaaaaatacaaaaacaaaattatccgggcatggtggcaggcgcctgtagtcccagatactcaggaggctgaggcaggagaatggcgtgaacctgggaggtggagcttgcagtgagccgagattgcgccactgcactccagactgggtgacagagggagactccatctcaaaaaaaaaagaaagaaagaaagaaaaagaatacactaacagactaacattttctagagcttaatttctatatattgaagagatgaatattactgtgataaaatgccgcaaaataatgcccccaaatgaagcttatttgctactttttcgccggtctcattctatagatttctgtggctataccaagtagctgacagagatgagacaagacgtgatttgattggtgactataaatgacttggccccctttcagaagaatatgccaagtcttcctatatttgctcaaatttaacttgcattatgatattgctttctttcacatttagaagggctcatgtaattctaaaatactgttacatataaagttttaaaatagttttttaagaagcttcactttaaatttaaacacacactttactggctgaatgcaaccttcctttaatttatctttactgaattttgtcctggttatttgcagttttaaaaaatgcccatacacatgtccagggcattcacaattcttacaagtcttttaaactccagagatttctcttagggaagccctattcccagctttccacaggcgtatgggttgtgccttcatctctttctagctctggagatagtggtccctacaacaccaacataagtaggctctactttcccaaccctcagaattgctcactcatgatgccaacaaggtgtgagtgtccagctccaacccttatttcctttcctggtctaaaaaaaaaaaaagagaggaaaaatcatgcttcccagaaatgaataaaaatgcaagcattgtagtcttaatgtcatatcttttgtattagtgtcacataagtgaatggcataagtgatcaacaaaatattaccctacatacaactcagagttcccaaatcatgagttggcaactcctgacactgtaggagaatgtagttaagtcaactgcctattagcaaaacagaaagaatgaaaacgatattaaaccctacctaactgaaacaagacattaagggctcaccaaagaaaatgtttttcatttgtaagaaaactgagtgatttctcttcattgcaaaaatggcaaggaaactttgagtttctactccacctaagaaaagctgtgctggttggaagttctgattaaaggcgaatctgtcacaattctgagagcacatccccaaagaggcaggcactcaaggggacagcctctaagggacatgcagaaattaaacatttccaaagagatcctgtaacttgccagcccaatgaaatgtcctattataagttttcaatcaaaagacatgtcttgtggtccaaacctttaaatcaaatgatttgctgagcatgaagcattcaggtgctatcacccactatgacataccgactttacataggcattttcttttatgtgttcacctcgcttccgctgccccataattgattttccttcccctccttttttttttttgagagcgagatggagttttgctacactgcccaggcttgtctcaaactcctggtctcaaatgatcctcccacctcggcctcccaaagtgctgggattacagtcatcagccaccatgcccaacaaaaatgtttcccttttgcaagtgtgtacagttataaacctgaaatactgcctggaaggataacatcattgaagtatgatatagaaaggccaatttaaaaccacagaatttgagtattccttccctttccttctccctctctctctctctctctctctctcacaagctaattttgcctatcaatttaataaaatttcaatgggattcaatttatgtgtaactaatttataaacacaatgttaacctttaatgttttatatgttgattctgagaaaccaagagtcaggtgcacattcatgttatacagctgtccctaatccccaagccatggaccagtactggtccatggcctgttaggaactgggccgcacagcaggaggtgagcagtgggcaagcaaacgaagcttcatctgtatgtacagctgctccccatggctcgcattaccacctgaattctgcctcctgtccgatcagtggcgggattagattcccatgagcatgatccctattgtgaactgtgcatgtgagggatcaaggttgtgcgctccttatgagaatctaatgcctgatgatctgtcattctctcccatcactaccagatgggacgatctagtaggaaaacaagctcaaagtgcccactgattctacattatggtgagctgtataattatttcattacatattacaattaataataacagaaacaaagtgcacaataaatgtaatgcacttgaatcatccccaaatcaccacctcttcccccgcaaccctgcacccttggaccctcactcagtagaaaaactgtcttccatgaaaccagtccctggtaccaaaatggttgggaactaataatgtaagataagaactggatttgtctcataatattctcctaacaatgtagctaccaggctaggcaattcattaattccaaaaacttcaggtggcatgagttaataattccagagactgcagcagtggaagataacaggaaaaaatggaaactggtggatattttaaatcaatggcgtctacatgattccatacttagcaaaaccagggatagctgattccaactctgattctggtcttgtggagacgccatgaaaattttcttgtgataaccttgaggaggtctctggagccagaataaccgttatctattaccccctgaacaactgtcatgattcttgaatctacaaatatatgtaaattctgcttgtatctatctgtacctgcctcccatatgctcagggttatcaccctctgtatcactccttctcaaagtggccgcactgtggcatcacctgaacagcttcaaaagtcccgatgcctcactacctcccccatcccaagaagttgatttaattgctctggagtaaggtctgggtatgtggagtgctgaaaactcccctcagatgcttctaatgtgtacaagctccaccatttggctgacttttttttcccctaaaggcaaactctagatcttagtcatctcctgattctcagtgtcctcttcacagtacttctcacaatcagtctgtaattagaaaactggtgagaggctgggtgtggttgctcatgcctgtaatcccagcactttgggaggccgaggcaggcagataactggaggtcaggagttcaaggccagggtggccaacatggcaaaaccccgtctctattaaaaatacaaaaattagctggccatggtggcaggtgcctgtaatcccagctacttgggaggctgaggcaggagaatcacttgaacccgagaggcagaggttgcagtgatctgagatcaagccactgcactccagcctgggtgacagagcaagactctgtctcaaaaaagaaagaaaactagtggaggttttactaagtctgtctgacccacgacactgtatgctccatacaattaggaattatctctcttttgttcaccacatccccattcctcaaagagcagcagaaatatggtacagaatgaatacttattttgtggaataaaagaaattaactgatctacagtgaaaaaataaaaataaaaataacagcagctagcacttacacagacactgtttgccagaaactgttttaacagctttacaaatattaacacatctattaatcacaacaaacctacgataggtactattatcatgtctactttatagatgaagaaactaaggcacacatagattaagttgcccaaggccaagcagttagtggcagagccaccaggattcaaacttaggcaacctggctctagaatcccttctcttatcagctagctcaacaatgcctggccggtgggagaggccacttaaccgccccttccatataaatgaccacaatacccatagccctgaagacggccaccacggccacaattttatggaatgacaacaaagtaccagacactgctgagcacttcacgtgttatttcctctaataatggattaactgcatcgtacagaccaaacaagcgaggtgaagagattctgatcaacttgcccaaggtcaaaaagccagaaactggctgagaaggaactgaacagacctctgtctgtcattgaagtgcaagctctcaatcaacatatataatgaccctttcggttggataattgaatattaaacaaacaaatgaaaaatcctaaaaatggaaaactaatatgcatgacaagaatacccttcaacaattccttgatccctggttgttttcactgttctctccgtactttcattaacatgttatgtagtatcatacgtcaaagttgcatcacatacacatttaatttatgtaaatccaactattcaggcacagagacagaacaagtaagtgagtgggaaagaaccaaaattaacgaataaaatctagtgggaggttgcaactgctattccattcaaagtacacgagttcctgagacagaaggaagagaatgagctctacataccctcatcgggtcagcgtctcaccatactactgggactcttgtgcttaaaggcactaaaatgtatgggtcacttaaagaattttcaaagttaatgatgatagtaaatatgttgtgccttaagaactgtctttagaccttcaccctcatatagggtgtaacaccactgtgcagtggctacacagagctagagatgcccaggatctacaaatgggaattaaaagtagctcaagtcatgtcttctctggcccactctctaagacagacatgaacatccaataacatgatataacctcagaggtggaagaaacagcaatgaagtctcatcttgatagtgaacgtatgaaataaaagaaaagcattcaaatctcaattcccaaatggtagttgacataaagactatttatccaatatctagaaaaagtcacatgctgattctctgaccacagagtaatctgtaaaaggagcttgtacaaagagccatcaaagtaaaaaaaaaaaacaacaaaagaaaacattaaattctatttttaaaaaaagcagtggttttttcattcctcatacataccgaggaaaaactcagcaaagaccttatgtcacatatcattatgaatcaattttcttgaccaaacatcaaagttgattcaacatctccatcttgaaacactctattatcacgatgtttgtcaaatactgaaagatctgaccactgtccttttccccagacagcacaaggaacacagataacaaatgaaggttgtactctgtagcaagaatagacaggagactgaatcacagcaaaacacttataaatcaagaggcggaaagaaagcgctaagagtgattaaatgcacgaagagcagtaataggaaagaaatctcttgtgaaaagaagcagttgatggtaacttaacggggacaaaaatgaattagatctacctcgatgactgagctcaagatgaggtaatttcataaagtttatagaaagtcacttaaaaattacacaacttgatgtagtctacttttggagagaaggaaaataaaagtcctccatgagggagttgatctttagaaaaatgcatttacaaaccacattgatgaactctacctattatctggaagattatccttaattctcatctgggtaacaaagtcactttagaatggatacagtcctctgcatttcagggacagattttgaaacagaaatagaagagaataaaaatcttcaaatataaggggttataaagcgtatggggaaggaaataaaaataagtgttaacagaggtgagctctgggccaccataggacgcaagagtgtgctgaggcatattctcggtttggttaagaatagtactcatggtatgtgaaacaggactttctgtgttgtcagtgaccgaaaatcaactctaatttaaggggttaaagggaaccagttggcttacacctgggaaggatgctaaagtaactcacagaaataaggaggagctatagagctgtagtagacattctcaaatgcaagcaaacacgagaatcatctagaaggcttgttaaaactcagattccggggcctcatcccagagtttctgactctgaaggtctggggtggagcccaagaatctgcatttctcacagattaccagatgatgctgatgctgctagtccaaccacacttttgaaaaccatggagtcatggaaacctaggctagaggaactaagccctatgatggcaggagcctccatcatagcatggcaggagctttgctcctggagcttacacaggctttcaccagctactagggaatgtagcctcctgggccacattattttctttcatgatcccagaggtaggtggcctctttcatgagcttccacagaaaacccctggggaaggttctaactagcttgagggacttgtggccagagaccatccctgaaagtaacctacaatggcagggatgcagtaaagcaattggcctggcctgggcgaaagcttactctgtgagcagtagctagggaagacaggatccaagtgaagacatacagagagaaagaaggcatcacattttacagcatcaccaaggtcaaggaagtatccccaaagagacaagaggaagattcatggaaaagcagggtgagcaaagaataggacaatgtgattaccgcagcccataaggaagttcactttggcatcaagatgtacaatcacattcacttatgacactgttttttttacaaacatatcatctacactcatagagtgctgcttcttacataatctgtgatgatgaatgaatttttaaaaataattccctaactcattgacttgtattattataaaatgtaataatgcaaattactaaaaaattgatattcctcttgcatgtcatggcaagggtaattagcaatacaagtttctaaatgcttattctcagtatctgtacttatcacaaacctaaaacagctcacaaacaggcactggtacataaactggcatgggtccaaccacacactttcgagcattactgctctagaccacgtggaccaggacttcttggtcacaacttcttaactccttaagaaagtgaatgagcacagctgtattccggtacaactttatttacaaaaacaggcattggccaggacttggccatggactgtagtttgtctgtccctactttagaccagggcttttcaaactctaacgtgcacagcaatcacctggagatcccatgaaaacacagactgtgcatttctaacagcttaaaaattgttgtcaacactgacagtccatggctgacattctgattagtaagccttcacagacaaatctcagtaaacctagagactggtatgtgaccttaagtataatattgctctatactgggtttttattgagccttaaaaagactgcagaaaagactacatctgtcattcaggtacctacctttctctgctttaaagagattattacaatcagaaaaaaattgataaggaaagccccattggaaccaatagcatcaaatatcggatggtttcctactttctcgattagctcctaacttgacacatagtaggtgctcaagaaataattgttggcagggcgtggtggctcacgcctgtaatcccagcactttgtgaggccgaggcgggcggaccacctgaggtcaggagtttgagaccagcctggccaacaaggcgaagccctgtgtctactaaaaaatacaaaaattagctgggcatggtggcactctcctgtagtcccagctactcagaaggctgaggcaggagaatccctcgaacctgggaggtggaggttgcagtgagccaagatcatgccactgcactccagcctgagtgacagagtgagactatctcaataagaaggaaggaaggaaggaaggaaggaagagagggagggagggaaggaagaaagaattgttgattgcaggctggatgcagaaataccaagctgtaaccactagaagagaaatatagtatgctgatggggcttcactttccgtcctataccttatttaaggtatttcacactgtaggataaattggtgcaactttcaattggcagtgcctttaaggaagtacctgtatagaaaaactgaatcaaagaatttgttctttcagtataagttctcttcatgtttctatacttttgtatttttttactttagcttcattcacccttcttatttgaataccaaatatctattctttggaatttggtcagcactgtcagcatttggattaactatttggtcgttcagcttaatggagaagaaggctccactcatgaaatgcaactactgatcacaggttataaaacacagaaaatatcagaaatcatctaaatatgaggtgattttggtgttttctctcacacctgctacccaaatgccaagactcttggatcataatgacacacggaagattctaagtcacttttgtctccctctcagagaaatgtgctacttgggattaacgagcaagtgaaacctagaaggtcaagggttaaagctccaaatggattttctgcttgctgtttacgatcttcaggcctttcagtattagagcagacacctaaacgtttgctcaaaaactttctattgagttctaattgagaaaaaaggatgtgtccagaatacttagagataacaattaatgaaaaaacccacagataagctggaagaaaaataattaactcggatttgtaccagatggcccttgggaatgctaatatgtgtgtttgcagtgctccatttcagaagacctcaaaggtggaaatgaagcattctcaggagaggttcctgggtatgcagatgaaatatccattgatattcagaaaggacctctaattgcgagagagttgccacccaaattagggtaaagttgctgcgtaaactatttaagtggacaaaacttaaaaaaaaaaaatctgtaataaagcaagcaacattgctcagaacactttggtaggtcaagacaagagaaaggaggacaactccgaggggcagattctttcattgatagcattcatgtcattacccacaaactccaactccaaatcatggaacggcgatgacatttctttctctaaggtcaactatcagagaggtctgcttggacaaatctatcagaaataacaaacacctggcattttcaagccccctttcatttttatatttcaaactagcagacagcaccagcagatatattgcataattttcttttactagttactcaccagtgtaaacgattttctatcctctttaaaatggcacctccagtgaacaagacgagatgtatttcactcactgctttatcctcagtgcctataagaatgcctggcagggatgacacttaatatattcttgtttggctgatgtttctaaatggcttttaatccagtttagtcattctgtggtctgaggaactagtaactgatttcacaaaggggtctttgcagagctgccccctgacatgctggagaacacccccctacctactcaagtcattcttgctgtggaatgaatcttgagctcatggttgacaccctgacttgtacctatggctgagttcctggcttagttatctgcctggtacttgagtctccctagaaccaagctttggcttacaggaggcttgccatgaatggagtttggcccttgcactagtgtgggattggtggtactggctatttgttaaaagaattacctatatgttgtttgggaattgcctccctctgtgtgtgctctggctatcttctaacatgctgctttcaggtaaggcccctccctactgccacaatccttcctgtacaaccaaccatttcctgtacgcattgcctctggctgctggatggaacctcatcccactctctgcaaagagtccttccttccaatgcttgcctgactctggtgaacaagtctagtcctagagtatggcccccaccagactgccccattgtattacagtcttgccagacacatggcattggcatctagcctggaaactgaatcgtttcagaagggcaactcattgacttattacgcttttcttcctggctgagaatattcagctagatgacttatatggaaataaaaaaataggctgacaatatgagtttgttctaaaaagatatttttggggcatctaccatgttctatgtaccattacaggggctacagataatgaagtatacaatagttgcataaaacaaaaaccttgaatggggagaaaattcaggaaagctctataccttgggtatttttaaagaatatggagcaaaaagcaacaagaaatgtggggatggggaagggggcaaacaaactataatatttctgagcaattttacagaatttttaaaaagaagtgaataaataaagagattattcagcggtgaggactgtaaattgtaaatatcacatgaaaaagaaaaaggagataggcacaaattatccccaaggatacatctgatgatggttataaagattaaaaagacgcttaatttagaagttcacctggagtatgttgctcctttacaaagacagaaagtttggtgggaatgcacagagaaatcagtggaatcttaagaggtttttggtaaaataaatcatttgaggattctagcaagaaagagaatggaaaaataaaggtgagttcattttctgaccagtaccaagtctcattcttgacgcctcctaacctcactgacctgaatataccaggaagacattgaacaggaagatattaaactgaaaaactcggaaggtgcattcagccacctctggaattcttaggtagtttagcatcccagcaacttagagggactgtgtcaaatattaataaatgacttgccgttaattctgagataattaaaactaactcaaattagaagtccacagaggtagtaattgtataaaatacataaaaaatatgtagcttggtcctgaattatgttaattttccttttttattgttataaaactgttatgtacccccaaagcttttctttttctttcctaagtcttatggcttactgtgaaacaaagctcttcatacttgttactattatatttgatttctgactgtataattccctgctttaagcaaatctggtttacaaagttccacatgctttttgaaagatattttatatgttaggcttctttaaataaatatctaaaattaaaaggtccattatactgctaggaaaatgatgatcaagaagactaacaacatgagaagatgttcatcaggcaatgacacataatgctggaagaaaattttttaaaatgataatagtggttgtattacaggaatacaattaggaaattttttaaaatatcacacttttagtaggaaatgtaaattcgtaaaggtgaaacagcgatcattatttaatatttaaaaacttccaaaaacataaagtgaaaataacctaaatttgtaaggaaagcattcttaactgaaacgttgaaaaactaaaatttcctcaaactttaatcattccatagctataaaggcagtatgtctaaaaagccattactggcatattctaaaggttctcataatcaaatccttcctttaggggaacaagtaaactatgataagaaaagttttttactttacatttagactgggggtttctgattgtcctttctttaaaagtgtctcagcttggcgttgtggctcatgtctgtaatcccagcactttgggaggctaagaggcagatcgcttgagcccaggagtttgagaccaggcagggcaacaaaccctgtctctacaaaacaaaattcaattagccaggtgcagtgtcatgcacctgtagtcctagcaactcaggaggctgaggtgggaggatctcttgagcccaggaggccgaggctgcagtgagctgtgatcacaccactacactccagcctgggtgacagaatgagaccctgtgagaaaagacagtcaagaaagaagaaagaaaaagaaagaagaaggaaagaaagagaaagaaaaggtgtctctatcatataatctatgaaaagctgctcataattatccaaaacactacccaggcaattctcattatccacagtagttatggtctatacagtcactaaaaccactgaattagcaaatactcaaccattgttcttagcggaaaaacacagttacatttttatgagcctctagtcacaatattttcatcagcagatcaattcctaactttgttttaagtatgcttctgtttaaagacaccttatttaatatatattgttgcttctcatggccaacagcattattaactcatgccgaatgaagcttatctagcacctgtatgctctctgtagggtacatcccaggcttctgacacttaggaatgctagaaagcattcaatactatgcttgggggccaacagtgaaatcatacacacaaaaaaggacaaaaatgcaaaaaacatggccataaatagactgcaaaaggacacgttttacagtatgaaagctgaaacaagaaggcagaggattgcctttttgatctcatttgggaacatgtgcattgggtgactaaaatttttcaccactctgcacattgccttgaatgaccttgaaagtgctgtggaattacaaatgacttttggagtacaaattaattttagcacacaggcgaatttccaaatacagaacaagcaaataatgatcaactataccaagaatactaagagaaaacaatgtagattagattacagtgaaattcctccaacactctaaaagcattccttggaaataaaaagaatcttattaataactagaggaacatgccacttctgatcctaatattcatcttgctttaaacagaccaggagaactgtttcctttgtgggaggggtggggggaataccatttttgacttgaaattgtaccatggtatgttgattcatgaaatcacaaattttaaaactctaaaaacaagtttcatgggaaactaagtaaatcatagtaaaagacactaacatgcatgaggtgatctcaatatactctacacaatagtatttcaagtgtacatactttattatagtgagacatcaaaatttatataaacaaatttaaagacaagagtcaagatgtgggaaaacatgactgatgacataaataaaactgcccattcccttgatctcaaacacacatatacacacacacacacacacaaacacacacacagagtcctgtgttctaaatcactgtgagaattatgtaataatggaaaactagacaaaaaaaaagaaaaggcaagtcataaagaggcattacaaatgctgaatagaagaaaaagaatttaaaaatgctacctctcctgttggtaaagaattacagcaatgatagccaagacatgggaaaataaatgggcagtcaactcactgatgttagccctctacaagtccttcaactattactgaggtaattcagcaatgcatgtgaaaaccttaaaatgtgcatacattttgacccttacacttctaggaatttatcttatatgaataatcccagctttatgtaaagttatgagaacaaggaggttcatggcattattttaaatttgtaacaccctgaatatcaaataacagagcactaggttaagtaaacttgtatatccatacaagtaaataccattccgccactgaaaatgttatagagaactgtactaggacaggcaaaacacataaaaaaaagaaagaaagcagactatataatattgtcaattatatgatataagtctagttttgtcaaaactagtgtgtgtatatatatatattttttaaaaaggtatatataaatatatctgtgtaatctattttataattttctcttttgtttgtccttattttaataattaggaaaagggactactatttataaaataacctaaaataaggacaaaagactatttagcaaactactaagtcgagccaatttcttaggcaagcccatatggacatgttgctcgtttaggaatgagaccatctttcctaattcctaattctctgacagtgggtggggcagcatggaaagaggaaaaaaaggattcacagtatctgcaatctcctgaatccatggggcacatcccaccagactacatctcacctctgctatacaggaaaggaatcagtccaaaggatttcagccttgttcttctgaatgattttcctaagttcactacccacatctaatgatgcctttaccaggctttatctgaattttaaagtaacatctcaaaaatactaatagtacaactttcagatgccctgccacataagattattcttaagatgcagagattcttgacattattcccgaccattattgattgtcttgctgagaaatgcactgttttctaattgttgcattcaatgcttcattttctctatgcaataacattaaggaaaacaacaaccctaactcttctaataattatatatttttccaaactatatggcattatactttgattcatggtccatttctctttaacactctacaaaggcatctacacagaggactcgtaatcaattccggagcttgctgggactaacgacaaaatttactaagccccaaatctgttaaattattcaagtcacttaccataaaacaaagtaggttgcattaaaacctggattttgaagacagagtaaagagtaaaaatcttatttttggcttgtttctgagggtatgtcagtgaggagcatgtaaatagattttgagtgttctattagggatggtttgaaaatgtggtagctagcagatacaccgatcatgtggaagacacaaaaccaaatgcagtcaccaggacccacttattactgagaagtattggcaggtaaaatggaacaaatgtgaggtgggcaaggagggccagatattcttggaaattttaattaactagacatcaggaaaagatatgcaaaaatcaacatttatgaattcctcacactgggaaaactactgccgggggaaaaaagaaaagggcccagagtggtagatggttttccatcctctagcttatgcagagtgacttccctaaataaagagctattctaagtggaagtggagactaaatgaccagctgatcaacacaaaattaatcattctccacagactagactatcaggtcgactaccactagaaagaatggctgcctggaattttaatcttttccactctatatgaaaaaaatacatattttcaagcaaacctgcaagaatagaaatgcagggtagtcatttcaaaaataatgcttgtgttgtataaagtattgagcactatattcgaaaataaattcctacaagagttctacttccctacaaagaaaacagtcgcttgcagataaggtatttcagcaaacacatgtggtgtgtaatgaaatgggttttgctttgttacaataaattaaaatggacaccagacctgaagaatctctgagcagacaaagccagttaggcctcataagtgatcttaactctgcttgatttgcagacataaacaaaacttgagctatttcttgtaaatgcctatgttacagaaaaatgaaacttaaggctaaccaattggaagcagaaagttctagttatctaacttatggttacataactagaactttccaggaggatagaccaaataaggcaacagtataactgtaaccaatccagtattttctttgctttactttcgtgtttgccctataaaagtcttcccttcacattcttttgatggagccctggaagcacttttggtttggagctgctcaatccgtgaatcactggttattcaaatcaactcctgacaattttacggcacctcagtttaagtttaaacagctctgtgcctcagttatacgcatgtatctgaaagaaaacaggatattcttctttgtacttaaataaactctaaatgtgcaataatttaaaaatatgagacagcacaagtgaatcctaaaatatattaaaacgtaaggcatttgcatatacctgattctgaaaatatggcatgcagttttacttctctggcttcacattctaaagtttctgaaacatataccatagagcacaaaaagagctggcctcttctcaaatttataacaaattatattttgttcttctttcaaacatgaatttaatcctccctttattaactgtttccttggttgtctgagtagagaatcattgtaagctgagtcacttacaccttccatcaatttcaaaacaacacatgaagtaacactgattatcactgaacctgtatcagacacctcccatttctgagatgtgcatttattctaaatctaagttttggaagtgataatggaatgaaacactcagaaaatataaaaagccaaagttttcactatgctttagaaaggtttgcaagttggtacttaaaacaatgctttaaggtattattttcatgtctatagatgaggtaatacaagtttacagagtatattcaaatggctaataaatacatgaaaaggtgctcaacctcattagtcatgacagaaaggccataatgagataatgcctcatacttacctgaatgactaaaattgaaaagactaaccagtagcaaaagtaaagtaaaagataacaaatgcaaaagagtatacagtacatgattccagtgatattaagtttaaaaataggtaaaacaaatctgtgatattagaaattacctttgagggccgaacacagtggctactgcctgtaacccaagcactttgggaggcccaggcgggaggaccccttgagatcaggagtttgagaccagcctgcgcaacaaggtaaacccatctctactaaaaatacaaaaattagccgggcatggtggcagacgcctttagtcccagctactcaggaggctaagtcagaagaaaaaaaaaaaaaaaagagagaaaagaaaagaaattacctgtggagagaaagcagggtaggaaaatgatggggactgcatgaggaggaggcttccaggatccctgttatgttttatttctttttcttttactttttttttttttttttttccagacgaagtctcgctcttgtctcccaggctggagtgcaatggcacaatctcggctcactgcaacctccgcctcctgcgttcaagcaattctcctgcctcagcctcccaagtagctggaattataggtgcctgcaaccacgcctggctaatttttgcattttaagtagagacggggttttaccattttggccaggctgctcttgaaatcccgaccttctgcccacttcggcctcccaaagtgctgagattacaggcatgagccaccgcatccagccatgttctatttcttgatctggctggaggttagatgatatgttcactttgtaataattcatcaagctgtatacttaaaatttgtatactgttctgtatggagattatactttaataagtttattaaattttttaaatgatactgtcatatgaaattattttccctctaaatgaaaagtgtgcgtgtgtgtctcaatatgtgtaataaaacaaccctctgaggtaagtactgctattattaccactttataaacgaggataccaaggcacacagaagttaaatagcatgcccaaggtcccacaaccagtaactggtaaagacaagactggaacccaggcagtctggcataagaatcccactaagagtcccttccattcttcaacttgtctttggtgcttaggtagcacatttcttcctagatatttcaagggcttagaaaatatgattcaaagttggatctaaaccaggaagtacaatcaaatccaatgaggtgcctttactaatgccaatcgtgtacttttgcttttcaaaactaggcctccagagagcaaaagatttgcttatctttggccaacagagttggggtcatggagagattcgtgccaagtgtcctttccttgtattcacttcacaagatgtttcgtgtaagtgaacactaggtgttttgtgtaagtgaacacaacatattccagatgttacatttgctacacctttggaattctaagttcagaattaaaatacaaaccagagtataatttggaaaacaaaaacccaaggttaacattctatatagtgcttttcttttaaatgtctttaaattcttaacagaaaaccacaaaaccctacttctatttcctattttatacatttttgctctttatgatttaaagaatactaatgcttagaattctttaaatcaaaatgatgaagaccaccagcagaacaaactctattacttttctctcatctcaagctcagctggaaaataagagaattataaaatatttaatgatatactttatatgaattcagttcagtaagtgagtttatcttgaaaaagactcttgttttattcagcttggtagaggaacttcatttcatatatatgataaaataataagaaacgtattagttgtagagatacttgtgttaggtccaagtgaaaatcagcatttgggttaacagtcaagcaaaataactaaaattttcagctctatgactgacatcatgagtggaaatatatgtcaacctgtaataattttattgaatgacgtgtttactaaacagaattatcttagacacactgcaaataagcagttgtaaatatcagttgataaaagtttaacaaaaactggtgttctgtaattttgactttctgtgtattcaactaactaatccttacatctaacaagacaattgacacctttgaaataattagctttgggctctcaggaacctctacttttgggcaggtggacacgaaataattactgccaaaactacagccagtttgcttgcaaaatcacatcaactcatctatactattttttaggttctgttctctaaattttgtgaaacgaagccaggattgaaaatactcattacatttctatgttttttaactggttttgaaatttcaagatttggaaaaagtactgtgagatgagctgtgcattcattttcctgatatagcatgagaaaaataaaataactcccacatacctttatctacccaagatgacagttaatctcaaaaaaagttgaaataatccaagcatttgaaaatgttccataaagtcaaaattttggaagagagtggtttttttaaaagaaaaatggctctgacagtaatttttccactatccctccccatcctacaggttttacaaaattaaaatttgaggtgagccactaagaaaagctatttcaacgaaatccaatgattgtcctggtagatttcatctctcagtggctctctattatcctttgcacagagtttcagtagacgctaaaagttcagtattttattacaatcgtctgtcctctgggtactgtgtggttcaagcagcttaaggagctgtgtgtctcggtatttacagatttcaattggtttgggaatctctgggaggaaaatgattcttcccttagaaagcagtaggaagaaagaataagtgaattaatacatgattagagagccactgataggtgtttctacctaaccaatgaaaacaaagtgcttatgtaagtggaaacattgttctttttgcgaataccttccttatggctggctgcctttgaacttcaataacttggctattcctgaacggcactggagaactgaagataagtgctaataataccttgccgtctgttttgtgagtcagaagaaaagacaagcaaaaacataaggccaccaactatgtaagtcatgaggaaaacagacaagtgtactaccaatataagacaaaattttatgcatgcaaaacaaaacaggctattgccagtatatttattaatgggaagcttccatatttagttcagaccacatttcttttttaaaaaatctggtattattttcatttatcattctcttagtaacaattcagatttcccacatcttcagatattttagtaaccaactcaatatattagatactctaacaatattgagacaatgattctcaaataaaagtttaggccaattgtgatggctcacgcctgtaatctccaagatctgagggcctgaggtaggaggatcacttgaggtcacgagtttgagaccagcctgagcaacacagcaagacaaaaaataaaaaaaaattggccaggcatggtggcatgcacctgtagtcctagctactcaagaggctgtgcgaggaggataccttgggcccaggagattgaggctacagtgaactatgataacaccacagcactccggtctgggtgacagaacgagaccctgtctctaaaaaaaaataatcaaaaaattaaagaaaaagttttatatcaaattgttgtggcatatacgtacttcacaggcctgttaaaagaatgaatgaaaaccgtgtacattagactttcaaaatattttggtctttctacataacaagcatctacctaaaccatgttatagtcaactgagtatctacaggtgaaacaaagcatactgatatttaacttccttactaaactagctgattaaatattaattgaatgcccacactgcccctagcatgggtgtggtagctacattctagttagctaccctcaagttaaaaagatgcacatgaagcagcaatagtaactatgaaaccaggtacagttatttgctacttagtacatatgttacaaactaatggtcagagataaaaattagaaagcatacaaaagaaggtggggccattatttcccagtgatttttgatcccataaccctaaaattttccaatatatggtaataccttcagcatctttatggaaggaatcatagtactcttccctctaaatcatgtaagcataggaccagtcacttctgtgtaaattacccaaataaagttcatgccaaccaatgtttcgactggcacactgtatcttttttatttccttccacctctcaggactgtacacacaacctctgaaataagatcccaagccttttacccaaaacgagttaaatcatcacgtattccaatgtgatataagacagaagttgtgggctgggcgcggtggctcatgcctgtaatttcagcacttttggaggcctaggcgggcagaccacgaggtagggagtttgagaccagcctggccaacatgagaaaccctgtctctattaaaaatacaaaagttagctgggcgttgtggcgtgtgactgtaatcccagctactcaagaggctgaggaagaagaatcgcttgaacccaggagacggaggttgcagtgagccaagatcgcgccactgtactccagcctgggcaacggagtaagactccgtctcaaaaaaaaaaaaaaaagatagaagttgcatctggggctgcagagtacacatattgacttatcaactctcaccaggaagaacaagtgagctcttgacggtgagaaattaaaactggcatataatctccctacaaagagaaaggttaccttaggatcagctgtgagcaatttgaatgcttgatatacttgagcttcctttacaccacctccaagatccaagaagttggctggcttcccaccattaaggaaaatgatatcacaagtagccatggcgagcccagcaccattcactgtgaaatgcaaatgggacacaagacaggctacatttagcaacatgaaatggtccataaacattttccctcccccatattgccaagagagaactctgtcattgccaggccaatttatatcctgtttggaattccattaaaccagattagttcatagacttttaggataaagaatcaggacatgtatatgcaaacaatgaaacaaaaaagacttaggaatgaggaacaggatgtattgggaagttaaatcaatctgaaaaacagaaagaaggaaaggtttaagtaagtaaccgatttgggccagtagtaaaaaaggaagttttaggttctgcaaagtgtaagcttaagagaatcaggaggcagagaaacaagctattggaagttgctaggacctatgaattacattctttttaatatactttaagagacaggagtaaagaatggaattctcaatgttttgtttgctgagaatatggtcctttgaatgtggcatctgtgggattgaaccacaggcttcccaacttcagtgggattttatacttttttacacttagtacagtcatacatgtttacataatgttacctggataaacttagaaacaaatgaacaaatgactgcacaaaaacaatattcttatccccttgttcctctttcaaattaatataagcaatgctcaccagcaacccaaccgttaaaactggaaccaaaatgtgccaacatcttaggagcctttcttaagaaagtaggtagagagttttaatatcaaaagtcttgttttccagagctaagttttattgatcaattgcacttattttgcttcttaagcttaattatataaaattactttccttgagagagaaaaaaaaaactccagaacacagcagaaactcacaaggtaaagtacctttcatttttctgaccctccaattccctagaaaagcctatgactgtgactaattaaatttggagtaactaaaataaaaatggtttacacagaatcttaaaacaatttgaaatgtgtaaatcatagattttgaggctgctatgtggtcaaaccatgcacattcctacagaggctataaataatctgtatttaatttggtttaaacccatatacctttcccctttctaaatgcctacaaatattgagagtgcattagcttatcaggatcagaatgatgtgagtgatctggtacattatagttattgctccaatacaaagcaagagcttttggtatcacttgtaattggatgtcattttctattgtattgaacagccacctcttggatgaggtctcttcagttctgaatacaatgatattgctggtttaatgagctacaaatcatttttattttaattccattaagattaagacctcagtttccagtacaatgaattgattctaccagaaacacagtcttgtgcaattaagtcagaagcatataaatctgagcactataagctgtgaacaataatagaaactgtattgcttctacagacattcttatctcagctgaagaagccattttcacaaatttagatgagtgtgataaaatcaattgttttattaataaactagcataatggattaaacatttcatcctttggttatcacagaacctgaaactttagcaacgtgattaaagtgtatgtcctcttctatttcctctgataaaggaattttgttttaaacctaaatttcagaagagttctgcatattaatactgagttgagcagcaaaggttctaattttttactaagcaaagtttaactgagatgttttaagtcaatatttctcagttggggtgatttttgcataccacagccatttggaactgtctgaagacatttattttaatttattgatttacatgggtttatttgtcttcacaagtgggggttgttagtagtatctagaggttaggatgctaaacatcttatgatgtacaggacagtaaagaattatcccacccaaactcccaatagtgccagagttgagaaattctgctttacaccagtgaccattaatcaaaacaactttgagaagaaacttggatactttcctaagacttttcagctacaaaaaaacttatgtgcttacttcttcttggtaagtgacatttcagaaatcaaggtttcctaaattctataagaatccacaaagcattcttttgatataactgcttcttaccaaagcaggcaatgttcccatctagtcctatgtattttagatcatatttggcagcttcattttcaatgggctcattctctgatttgtcgtccatagcaaatatgtctttttgtcggaattctgcgttgtcatcaaagtttatcttggcatcaaaacagacaactaaataaagaagaaaacaatcatacttgaatatctcttgaggatctataaattaagttcttcaggctggtaggcacaagcgaagggaaagttaagtactgtcattttttttcacatgttacaggcaggagaggctgctttggctttcttgacctttaaattttagggtttggtccctgttgtcaagggacttacgttctagtaaagaacatagtaatttctacctgttgttctcatttcaatagaataaccccaaaagttgccatcaaccattaaaagttacagactggcacagcttcatagatacagctttgattcattatttttattatatatttttagtatttaaccactaattatcacctttctcttctatgtaaagagagactagacaatattattaattattttgtcccctattgtccttttcttgatatggtaaagtgaaatttttattgaatcagtatcctgtctagtatttccaaaagatttagtggaaagaatgccagactagaatcgctcgatttttatttgatccttaactaactctgtaacatttattaaaaataaaaattgtatacacttgagtcttgaacaacatgggtttgaactgtgagggtccacttatagctggatttttattctcaagatgtaaagccccagagggtcgacttttcacatacatgggttctgcaaggccaactgcaggaattgtgcaatatgaacgaagtttggtatatctgagattcctggaaccgattccctgcatatattgagggacaactgtgtatttaaagcatacaacatcatgttttgatatacatataacacagtgaaataattaaacacagtgaaatgattactacactgaagcaaattaacacatccatcttctcatatagtttttggtttttctttttggtgtgggagagcacttaaaatatatacttttagcaatttccagcatacattactaactctgtaaccttgataaaataacctagttcttctctgggccttggttttttaattggaaaaaatggcaataacaatccttaaaacaagggccatgcccttgattcgtgcaggaccatcttatggtgcttcagattcaagttataagacacgaaaagaccaagactggtcagtcacaaagccaggatgccaggcattattagcacaattgtctctagtttctggagctggtggaaatctcctggacccagcaaaactcattccataataggagacagactacagggcactttccttgatttacagatctcctatacatacaatcagggagagactgcagtggagagggtggcattattggtatctgggtatctgaccccttttattatctctcttagtgtagaaattagtgttctgtgatgccatgtcatcataatgtttgtttgtttgtttatttatttatttatttatttatttcggagacagagtctcactctgctgcccaggctggagtgcagtggcgcaatctcggctcactataacctccacctcccaggttcaagcgattctcctgcctcagtctcccaagcagctgggactacaggcatgtgccaccatgcccaggtaattttttgtatttttagtacagatggggtttcaccgtgttagccaggatggtctcgatctcctgaccttgtgatctgcccacctcagcctcccaaagtgctgggattacaggtgtgagccactgcacctggccaatgttcttttacttaacttgggatattgatagccaggaatctttgaacaataatttacagatactacctattctcctccagcattgctgacaggcacctgactcttgaaagggaaacagccacagaacatttctcactcactgaaaagcagtggctataatctcctaattatacttgcttcttatgaaaataaaacatggctgtatatggcatcttggcgttagagaccccaggtagagggttttctccaagggtttccctaccacaatattcaagcactttgatacaaatctgtgtagaccagcatattaacatctaagaatacttgttataagtatatatatagaccgcacatgacttaaagtagcactgagcgacaagagagaatcttatatggaagttaatgtctgcttaaatccttagtcttgccccaaaatgcccaaccactttgtccacacattgtgaatggttggagtgaatgagtaattactttccaaaatattgaaagcttattgacagaatcctacaattaccaaacgaattggccaatgttctctgcttgctacaggggaattttctcagcagttaatgactggtataataatcaataaaaaagcaacttcgtacatggctttccactaggtttataaatgcattctaattaatttattagtaattttagctcctccattactcattggcaagactacttataactgacaccttcaaaatgaatgggctaaggttatcaaattgacttcctaagggaagagtttcaaataaaggaattcttggttgagatcaataaacaagtaaatcaaaatagtttcaagctgacctttgctccttacaaagactacagttacaagctgcttcagagagagaataattaatgggtatgtattcaaagttcaaaaggcaatcccaactaaatgcctgcaaagctagattttcagaggatgtttttctgtggtatgacgttctctccagggaacaatcttgacagaactttgcagttaacccagagcttcaagatggtgactatgggataaaaggggtgtatatctacaacggtcctgtgccgactgttaatttgtagagaaaactaaacaacctaattggatcattgcatgtatgtctaagtgttttgggaagttaaaaacactacctaaatatgaagtaatttatttagaggacttaggacttaagaaaggggattcaaattgaactgccaccttcaagaccccagtctttacttagtgggtaagggaagaaaaactttaaggatgtaaagggattctttcagacacatatttgttacgcctgttttatattttaaaagtagtctgtgatactgtgatttataataaatatattattttggtcttcatccctaattcctagcatagagctctaaaacccttgtgatttcctaagcaataggggtgctaggagaatcttgtgttctaacatttggcctttgaccctgattcctgatgcagagctcctaatcccttgggattttctgggagataggagagtcttttgttctattaaggtaagtcttggtggaggcttctgtatggggctggtcgccagaaagaccaaactatgattagaagcttggaaatttcagccccacctccatgctccagaaagaataacagatcatccctatgtaataaagcctccataaaaatttctcaactccaggggactggagagcttacaggttgccaaacacagggaggtgctacagggtggctcacctgtggagtacagggaagcttgtcaccccttcatgcataccctgccccatatacctcttcatctggctattcctttgtatcatttaaaatatcctttataaaaaaataagataaaaaataaaataacctttataataaatcagcagtagtaagtaaagtgcttccctgggttctgagagccattctagtaaatgatggggcacaaggagggagtcctaagaacccccaatttacagctggttcatcagaagtaccagaggcttggtcttacaaatgacatccaaagtggagtcagtctgataagactgaccccttaacctatgggatctgactctaattccaggtagatggtaaaagaattgaattgaatcataggatacctagctagtgtcagagattagtcagtgttggaaaaactcacacatctggtccaagaagtgttcttctgtgttgagagtttggtaggagaaaaatgtttgtttttccctattatacatagtaccaaacaaacaaagtgctttcctatcttactatctacaatgttgtgccatctaaatgattttccttgaacctgaccacttaatatagactggcatcaaaaatatcagggtataaatgacaactcctggcacttcctagccagctatccttaagcacattaacctctcttaaacccgagccttgtctatacaatggggatcagagtatgttctactctaggtgttggtggcaggagagattgtatgcaaagcgcttagcttcctagacagtgggtactagcaggttgttagacgaccacaccaccctctaatatgcacatgcttttttatacttaagagcttcccattattgtagcccaggctacagaactctcctctcttcctaacaataaaaattatctgttcctttataatctgagatttctgtttagagcaaatctaagcaaatgtctcccatagtttacatatgtacaggttacccatggttttcaataaaaagccatcttctgaatgaataagaattttcccaaaggaagaatattaatagttggcattttaggcatcataaatagtagaaaacaagatttttggctaaaagataagggtaaaataggctgttggtgactctcaaatcacatcacacctgtgcataaggccaaggctaaagattggtacagaatagctccaaatgaagatctaagcaaagggtagcaactaagaccctcaagccagccctatttttatgaataacagattggaacatagcctcgttcatattgcctatggctgccttcccaagacaaaagcagaggtgagtagttgcaatacagactgtatggcccgcaaacccccaaatatttactaactggtccttgacagaaaaagtttgccaatccctgctaagtcacagttctcacacttgtatccacttgtgtgaaccaagtgatagatacacaggtgtcatattttatagtgaaggagaaacttagaaaaagtgcattccattaacatgaaaaccaaaaaaaaagtaaaataacaaagaaaataaataaaaacctgtggctacgcaaaaggagtagattaatcctggaatactaactgactcttacatgcttatttcctcctgtaagacgcttctaaatgcacttcttgaattgacgtgttaaaaatggattgatgtctatgtcaacagcagggcgataaaataaacttgcctgcttaaacccttagctttctcatttaataaaacaacaaacaatacaaaatgcattttcagaggtgctgagcttggtccggaccttaagattgtcaacgtcacattaatgaaactcaattctaaagaaaattcatcttgaacaaaggccattttttatacaaagtgggtgaaagaaacatacctattaatatttataaaacaattttcaccatcaaaagcacattgttacatgcttgatagattatacaaatgtattttccttctgaacgaatatcaaagaaagctgtggtacttatatgcatagggtgttttgttgttttgtttagtggcgtgagattctgtgagctgctaattcaacaatctcgatagaaaacatgactggcagttagaggcctctgaccctagaattttaacagaagaatgtgtcacagaattaaacaaaagaagaatacatttcagaggggaaacttacacataaaaggaacataaaacagcaggaaataagactatcataattagtttgaaaaataatctgtcttcaagcaacgtactgcgtttgatttgtgataaataaccataatgtactattgaaacacgccttgccaaaatggccttaaaatgctgatactttcaaattagtcccacttcccattaaatattgatgttctgagagttgtatactttttagaacttttttttagtggctgtgaaaagagaaaataggtatggggtgggtaggggggttgggggaggtagagaaccgaaaatgttcttgaaaatagagtcttgtgtataaagacagaaacagagaaacacccaccaacaacatgggcacttgctaacaagaagcaacggggtggttatttagggaaatcaatccgaagaaagaaaggaatttgatgtgccagttaactgtggatcacccagctttaattctcacggaatcttagccagatagtcactgcttcaaattggatctcattcctttggcccagtgaatggatttcagcttccaactgatgaagatgccccaaagcaagaattcttaatctctagactatggacagattgggtgaggtcgttctctgtgaacagggaccatcctgtgcgttgtagtttagcattatccacgccagtagcatagcctccaagttgtgatgactaaaaatgttccctgggggacaaaatgcccacccttcccatggagtacaacttgctttaaagacatcagaaaaaggagtctgtgtacagatagagctggctgaaggtgagaagaaatatgacatgaaatttcacagtggctagcaaaatgaatgaatgaatacatgaatgcgcaggtagataaataaataaataatgataaaacattgcttcttgcttggctgcagaattaatgaatgaattggcactgcatttggacaaacaaggaaaataacgattaatttctattgactaagtaacagtttatttttgtttcaataaggttgcatctttctggtaggcatgttttgactcagtgtcccttcttccattaagaaactgtatgtctcctataccatatgattcttgctcagtggctggcatgggcatagacatgtgacccaagcagggtcaatgagaatcatttgaagggatttatggggctgctgagggagagttatggagcactgggagccatctttgctgccagcttctgagagcctggctgagaaagaagccaatttggaggcaagcagggctggagaaccagcaaatccctgattctcttcaggccttaagccagtccacaccttagacttccctgttacaggaatataactttttaacaaaaacaaagctaatataactttctgtcattagcaaccattataatcctagctaagagtcactaaactacattgcagttagtagtgtcaaattatattttttgaatcagattattaatcacataggaaaaaagagctcttggactgcagttctttctccgtgtcaaaaattccctatgggtgacttagcagcatagatgttatcaaggcccttgttcttcactcaacacggcatcacttgttgtacaaatatatgaacaataacctgaattattaaaaatagcactcactgaccaatggaaggtcaaaaaaagtttcctacaaagaggtgggtacaggccaggcacaatggatcacacctgtaatcccagcactttgggaggccgaggtgggtggatcacctgaggtcaggagttcgagaccagcctggccaacgtggtgaaaccccgtctctactaaaaatacaaaaattagctgggcgcggtggtgggcgcctgtaatcccagatactcgggaggctgacgtaggagaatcacttgaactcgggaggtggaggctgcagtgagctgaggctgtaccactgcactccagccttggcgacagagtgagaccctgtctcaaaaataaaaaagaaaaagaaaaagaaaaagaaacaacaacaacaaaaaagagctggtacaatgtgatgctgagctccttaaacttttaaatttaaagaataattattaaatcaaagtttcaatgtggaaattttaccgtgaaatgttctgctactactgatctaaacagaactaacaaatactcagattataaatattaagattatcaatattgctaaaatataaatgactgcttttacagcttctaaataaaagatagcttgaggggactgtgataatgatgaagatcaatttgtacatttggtcattaatcaccatttcctaattgggtttaatttgactactgctcattagagttataaaccaacatactcatttaattgtgattataattcaattgctgaacttttatggtacaatgaacaaattaataactaaagataattttgctcttaaaaatatcacataagacttatgttttaatgaactgtatataatgttttatgatgattcccttaaaaaaaaatctcaagactcttccattctcttaataattaaaaatcaaacttcagactcatgacgttttataaacacagtctaagaaaaggttcccatacccctgttccctgaagcgagaacacagctcgtgactgcttcccaaagggttgaataaaaaatgtattgcagccatttttatcccactccatagctacagctacatttccatttttcttcatgcaaagcaaccaggctgcttgtgtatactagttgaaaaagcaatatatgacctttaagaacttttgttaaaccttctccttcatttcttggatttaattgtcaacatgaattctgactggtattccctgccaaactggagactacttctaggtcatgtacgtgaaagcaaataagtagtttaaatgggagaaagtagaaaaggcaggtagctgcagttgagtctggagtatcagaatcaatatgcacgctggactcagagggacatgggttcaaatcccagcttttgtaacttctgactagcccctgggacagtcacaatggtttctcaatcctctataaaatggggataacaactcctaatttttcagggttgtggtaaacaatatgaaagaatataggtataagcttatcacagtgtctggcatataagctcaagaaacagcttcttccccttcctttcttagctttataaaatacacacaatttgatagccatagcaactttaaaaaaaatatttatgaataaaggtagcttgtttataaatgagcaagcacagatttctatcggatggtcatctgtataaatcatgaaatatattatcttcaatggcttcctaaacataaaatctttgcttgttctcgtctgaaatctatactattcctgggctactctgagactacctgagaagaggaatttcattttatgaatgttagggactagcctattttgtatctgacactgcatgcatactcatatatgatttcatcttattttcacaacactctatgagctagacatcatttctaccacttatttgattgaaaagattgaaaaaaaaaaaaaagacctgaaacttaggcaggctaaataacttgcccagatccgtagccaaaacatggcagatacagaatttatacttaggcctctctgggttcgaaggaaatgatagtgtagtttctctgagtctagctacagaatctctgaaatgtgctaaggagaaaatattgtctcatccgtcttggtccaaaagttgatgtgtttacacataatgattcaccccagttaacaattcaatgcaaattactatttactgactgtaacaagctagacaacatgcaagacaccggaggtgaaatgtactaaaaaagaaaaggttcatggtgcttacagtctggtatccctatcctatccacctgccattccactgttttgacagcaaaagcttgtgaatttgtgtgtagaactccactttaccccttaccacacacacatttacaagcttttgctatcaaattaataagaacttatggaatatttgctgtatgcaagaaacagtgcagtggtggtaggtactgatatataaaagttatttatactctacaactacctgatggataggagaaaccttcaccacaaaaatgccacctcctcctgcctgaagcagaaactgctctccaagtaaggtgaaagagttcaactgggggggacttggggctttaccaaggtgatataaatccagcccagaacacaaggtgaaattatatacagatttaggcaaactaaagacgttcgaaaagttccagttccataaaggcatatgccttcattacacccaagtgtgtggctcccatttctacacaaatctttaccttagtagcagcagtgatgggcctaaaaaaataaggtggagagaaagaggtgaacgaatgtttctttccttttattatttattattattattattatttttgtagagacagggtctcaatatgttacccaggctagtctcaaagtcttggcctcaagtgatcctcccgccttgtcctcccaaagtgctgggattacaggcatgagccaccacaccaagcctgaatgtttttaagtaaaacaagcagtagcttccttagaggcttggcatttggctacaaacaaacctaagtgctgaaatgttcaactgcatcatgggagcatttcaaactatggcagaaattaaattactgaaagaaatttatgcaaagctgctgctacagtcttttgtgcaatttatagtttgcataaataattataatacattcatttgttttctcaattcttttttttttttaccttgtccttctggagtttcaccaaagggattcacttccacctgagtagcatcaattttcaggaagagattatacagcttcgtaatttgatctgcagcctaaatgtgatcaagtgaaatagaattacaccaaagcagtaaaagaaaatttattttgctggattaatgaaaccttaaaaatagcaagttatgtctttattttcagttaggttttctgaagggaaaaacagaaaagcataattattttaatttccactgctattcattaaaaggaattgctcagctctcctctagacaccagaagagaccattatcaagaaaagaaaatattttcagtacggcctaaaacgttgttaatctttttgtaaattatcatgtctctattagcagagttatgctgcaatataaattacaatcattaatacaaacaagctccatttaagtaaaaggtaaacatgattttgagagtttataatgactaggttttccttattgtgctgaaataaaacagttattatattcatcaatccaacccataatctgtgaaacaacaattactgagtgtctaatgaaaattgttgcaaaacaggaagatgaaagtgcttaatagtgtagttactgaacagcacaagttcaaactgaaaatagcttgtcccaaaggcattaaccacaaagggcaagaatatccaaggttgccctgttatgccctgacttcatttttctcacctctgcttgaaattcactcattcattcattcattcttttcaaccaacatttctccactgcctatgacacagcaagctggtatcttgtgagctggcgcttgaaataagagcatgaatgagccatgcccctaccctggaaagctcctggcaataacaaaaggagcatgtgatgcacagagcaagagggtggatcgtggagaagaattaggtatcagtctcattcccagctccattttccaagccaaagttttcccactgccacatttcactcattgtgccagcctcggattacttgcagcagatccgttttcagttctccaactctactctgtatatcagagaaggtgactcttacaggctgagttttctaggttcctgggtcagctggtttccagctggggtcagccaatggcaagcagtggtgagagatggaggtgggaagaagggaagagccagggtacttccactcctctctttctatctgggcagcacctcctcctctggctgttgctcccactggagaagcccaccagggctctagcttctgtatacaaggtccagtaacaccactgcctcatttttgttcctggagcatgtggttggatatgctttaggttgcctttctgtcaactcttaaagtactcagctcttgcagcgcctatgaaacacatccctaaagtaaatccccactggtgtaaatattgcaagtggttccagatttgactgaagaactccagatttaattcatgctatcttaatgtattttataaacacctacaaacatttttaaatccaaatttgagggctagtagatataaacgaacccacataatgagtatgattaaatatttttaatattaaatatttgcataggtagataatacatgtatatgatacaaaattcccgaagaacttaagggttttccctgattgtaccactcaaccacacaggcccccagtggcagccaactcataaatttagccttcatatgagagacagtctatgcctaacacagtacgcattcctccttcatctgtcttaaaaaagcaaacttgttccaatacctctttacttaacagaattttagagacacttcatcagcaacacaggtagatcaatcatatctttttaattgactaaataatatcttactgtattgatatgctataattcctttaacctttcacttaaataatgaccaactgcattgtttctaataggttgacattacagcactgccttatttatctctgtatatttaacatacatgtgattaaacatttgtaggataaattacccagagtgaagcaaaaaggaatgtagccattttaaacatcaaaaggttctgttaaattgttcttttttttttttttttttttgagaccgagacttgcagtgttgccagcctggagtgcaatggcgcgatctcagctcactgcaacctccacctgccgggttcaagcaattcccctgcctcagcctcccgagtagctaggactacaggtgtgccaccaagcctggctaattttttatattttagtagagacgggttttcaccacgttggccaggatggtctcaatctcctgacctcgtaatctgcccacctcagcctcccaaaggtgctgggattacaggcatgagccactgcgcccggcctaaattgttcttcatagaagctgtccctgatttccactcctaaaaagtgaaaattatcagagacactattttccaattcacaatcattagccatttgtatctttgtcagtgtgttaggtgaaaaagggtatctcactggtatggttgggctctgtgtccccatccaaatctcaccttgaattgtaataattcccacgtgttgcaggagggacccagtgggaggtaactgaatcatggggacgggattttcccatgctgttctcatgatagtgagtaagtctcacgagatctggtggttttataaagggggggttcctctgcacaagctctcttgcctgccaccatgtaagaagtcccttcactcttccttcgtcttccaccatgattgtgaggcttccccagccatgtggaattgtaagtaaattaaacctctttccttcataaattatccagtcacgggtatgtctttattatcagcgtgagaacagacgagtacactcacatatagttttaatttgaatttattttattatgaatgagtttaggcattattctatgagtttaagagacatcttattttttttgtgtgaattttgcctatttttctattgagattttggtcccttattaatttataggaagagtgtgagtgtgcgtgtgtgggggggtgtgtgtgtgtgtacaagagagtgttgctttgtcacctagactggagcgtactggcataatcatggctcactgcagccttgaactcctgggctcagatgatcctcccacctcagcctttcaaatagctggactacaggcacatgccactaggctgagctaattttttattttaattttttctagagatgggggtctcgctatgttacccaggctgctcttgaattcctggtctcaagcaatcctcttgtctcagcccctttaacatttaccttttgaacatgcttttgttacttttgccacatggaaatttcacaataatgtcactcttatatggcttctggctttgtgtcagacttttaaaaggctagtcccattctgagagtatttttaaaaattctcccattattttttctagtattctttataatttcttccatttttttaatccaaataaaatttgagttaaagtgcgaagccagcaaatacttcattgcggaatattttttgtattttagggggttttctaggtcatcaatgtgaccttgcaatgtgagttgcatggggcaggcatcttatgtatcctgggcaccttggcatccactgtagtgatacaacctctgcagagtcaacactcgataaatatcggttgaattaaagattaattcagttctaagtggggactacataatagaaataacttctgggtacacatatatatatatatgtataatctaatccagctacttcaaaacttcctttttaaaaaattgtgataaaatatacaaaacataaaattcaccatatctcaaccatttttgtctacacagttctgcagggtcaagttggtacattcacattgctgtgcaaccaattcctagaacttcttcatcttccctcacactctgtatcgctaaacaaactcccgttcttctcttcccactgcctctggcaacatcattctactttgtgtctataaatttgactattctagatagcatctctctctctgcctctctctccatctccatatatatatatattttcacacacacacacccccctctatatatacgcacatatatatctctccatatatatctccatatatatgtatatagataatacgtatagatatatatagataccagatatatagagatattagagatctctatatacatacatacataaaataaaagatatgcatatatatacatacactagatacctgtggaatcatccagtgtttgtctttttgtaactggcttatttcacttagcataatgtcctcaagccccatccatactgcagcatgtgtcagaatcttcttttacaaggttcagtaaagttccattatagtatataccacattttgtttatccattcatccacagatacacacttaaattgtttcagaacttcttaagcctacaccaattttgcttagtacaaggctgcattttctgcacattaatcccattgtaattatacattagcacagcattttggggatattttctgttttaatttttactgttgcacaaaggcagaccataatttttttgagcaagactaaaacataatctgatcttggagacatctccaaaccaagctggttctcccttgtagatctcacaatgacaaacccttgtaagatgtcttattccagaggctattcactaaatggttataagggctaagcagacagaatgtgtgtgaccaggtgtaacagggaatggcatggcatgtggcaagttgagattagtattcccactttctacaaaagttaaaaataagcacaggtcaaagaaaacattctcctggtcaacttgcagtcagtcgcttactactgccatctatttctcagctcataaccactgcgtacaaaaagtttttctgcacttttgccatcaattgttattttgtctgttaagtaatttttaaaaattaaaattcgtaaaatcaaatatacgtacatgaaaatctgacaagtttataaaaatctttaaaaatgtctcaaaaggagcataaggaggaatggcctcagaatcgtgcaggcacagttgtgcgctgcatcgccaagatgccattcccaaagtatactccatcgcgcctggccactccaccctcgaccctctacccagcggaatacgacatatccctggaaacccagcaggcgcaagccgagcggttggccataagagcacagctgaaacagcagtacttgcttcagtacaacgaccctaactgctgacggctcattgaagatcctgccttgatttgttggacctatgcaagatcagcaaatgtctatcctaatttcacccctaaaaactcactcttgggagctttgtgtggaattaggcacctgttcttctggtatgatgtattcaaaactgacaggaataggaaagaaaaacttatccaggaaggaaaattggatcaaacatttaacatctcatattaagtctggcaatgatgactatgtgtattcttgctgaaataaatcgtctattaatcaaacaaaaatctcaacaggttaagaattttaaatatttttcttgcattccagaaattatcatcaatattcacgtacgcctctcaaatctagccagaagtacaaaccacttcaagaggtgttagtgatcttgcactgacttggaccatccgatcttttcatcagcctaaaccttagaggcacatgttgacaattcgtggcactcatgttttcagaaatgaacagtatagatgataattaagacacacttgacaaacttgtaagtttcagtcatacaatagtcaccctttatcctcagtttccctttctgtggttttagttacccatggtctactgaggtccaagttattaaatggaaaggacaaaattatggaataagatccttggatggaacacagcactaaagtcactgacggattacaacctctacagccacacttagatgacctaaaaagaaagagacaaacttctaattatgatgttcttctaaaaggttgtggtgaaaaaccttcagctatccaggatccctgaccattgacatcatctgttcctgacatccagccattgacacccatggtttgatgatccaggatcatccaaagtagatgtccctcacgaagtattgccaggaggtcatgagaagcccaatgctacatcgcaatgctcacatcactcaccccacgtcttaccatgtagacattgcatcatctcacatcatcgcaagaagggtgagtacagtacaatgaggtattttgagaaagagaccatattcacatcacttttattacagtatattgctattgttctatttcatactgttgttaatatcttactgtacctaatttataagtcaaaatttatcctaagtataaatatctagaatatccagaaaaaaagagtatatatagggtttggtagtaggtaagcttcaggcatccactggaagtcttgggacgtatcctccacagataagggggaactactatattaagctttcctatgtcttaacgtttttcaacaaattctcacagaaagagactttggttgggaacaaacactggtaatttttatgtaaagcaaagtatcatctttatttttgttatgtctaatattcatcacattttagagacaacaggcatgagtcacaggaaagatattaataattttataagactatcattttatatgatattcaaccatgagtgaggtacctccaaatgcctaaaccacatcctagatgaaaattaagtaacttaactttcaaagtcacgttgaacctaaggtacctctaagatactatttccttaggaaaagatcattgatgattgtttaaatgttttcccttctacactgtcccatctgctcattgtacactggccctctagagcatttcactaatccccacagcttgagcaagccccataaagcagagattcccaagcctacaactctaatgcacagctttccctgggatcccaagccatatatcccttctactgtagaaatacactcaggtgtccctagatgaacaacttccaacatgtctacagctgagatcaacctctctctccctctgcccgctgccccctcccccactctctccttcacattcctttatccgtccctcttcctgtatcctctcagccagcaggcagatatctaccggtctgtgagcccctgaggaacaatggttatttttcattgtctcttttccccaaggcacagcagactgagcagcaccctatcagtgctcattccaagctgctgagaaaatgaagatttaaagcctttcatggagttagcagtgaaaaaagaaaaaaacaaattaaaacattttatttcctttcctcgataaattaattcaaaggtatactgacaatatggccacttacttatccctcagttctcacatattcgtcttccttccataggtaactcatttaaaacctagagtgtttcaggtaccaggaaaacaagaataagccatttaagagctgtaaataactcttaattttctcgtataatatgtagtgagggggcagtatcttgtgatgtacattatactgttattaacttctctagaactctctattatgttcacctcctgagcttttaaatatgtggtcagcagattttgcccactccagatttatttatctgccatgaaaagccacctattgctgagcctctaggaacttcttcaaagtggacacctagaagtgttgtttcacctagtcatgcacatgacaaatgtttcttgggcaataaaaatagatgccaagcactttgccagctgctggcaacacagcagtgagtaggatggacaaagtccctgccgtggtaaagattaggatctagcaaaggtgactgcaaataaataagagaaatatacagatgtccaaagtgatatggaggaggcagacagggtcactgtgcaactctggagctgactgccagacagtgcagctagaccacagtggctgtatggaaaacgggctcttggtgaccaccactgctacaggagaagccccttaataaacatcaaatgaatggctaatgtagctggtatcctcattctcaggaggtgaaaccaaccactgtagcacatattcaggaatcttccaggatcttcctttcaacagatcactttcctggcatctctttgctagtctcagaaatggcaattagttcctctaactgtccatcgaatcctggccctttctctctcatcctgaggtttagttccagatgaccctgttccattctaccatcttcaatcttttgctttcaaagtgagcctttattcattttcaagtaagtggtttcccttcatttaagcatatatattttttaaaaccttattctgttttatccctctttgacttgcctactgttgccattaaacttccagagagagtcaatcaaaagaaaaagacaagacagaaagaaaagagtgcatcatgtactgtcttatgggaatagtgctgcccaaccaaattaaaggacatactctgtaaccttttcataaagccccaggccagagaacatacacacatgcacacatacacacaatctagggccattaaggtggcctctctgagtaacagaggaaggaacaagtaagtttatctgatttagctgtgggactaggaagcttgccccactagacacataatcaggtgccatgggctggaacaaaggcagagcaggggacgatactaagacagattctgtccctcaacagctctgaggccaatgttttggtctttgaagccaagggatattattacaaaattggcatattttaagctgttctcaataaaatatcaagtttatgccatcaatattcatttcaaatgcccattagctatgaaagaatagcaattagctaaataacatgtattattaatattaataccattaagaacagacctttatggagcagtacaataaggacttttacacattattctactgaatccccacaataagcctctcgggagttgtcatcattcccattttatagatgatgaaactaaagttcgaatgagctgtatcacatgcctgccaggtggctaagtaccagcaatgctacagaaaaaatagagattaccatctatcatgaagtgtatgtgtccacatgcaatacacatgcacacacataccaaaacacattcaaagacacatcataaacatcctcttttaaaacatcagggaaatatttttcttcatcataaacagctggaggaaaaaattataaaacaataaataatcctgtttcctggtaatcacaaacactagaggcaatgaagcaagttcccaaatgttttctgaaacaagtcagacacaccatcccccaatggcttatatacctggcttttcaaaggcccaacgaagcctagattttcggccatccgctgagcttggctgtcctttattccttcaaaaatgtcaatttgctcctagtaaaaataaatcaaataaacaaaattcagacagtcaactgagaagatttacaacctcaaaagaaaatgcttagtatttatttgcaaatgagtaattaaagtgtggcatctatccagagatctctgagcagggctaccgcagatgcctgtagggtatgttttaattagcagaccatctataaaaaagcccttccaaaaactatataattcttcatggtggcatgctgacaagaaaatctgatgccagttttcacttttaattactatacagatggcattgatgaatatttagtcagttaattttttgacatcttttggaaggtttccaaagtaaggttttcctgcctactagtagttaagtttaaagcctgtcatagataggttaaatattaccttatgatttaaacactctattgatgataattattactgttaccttagctctacaaaatgatattgtctcaaagacaccgagcactgtcactatacattatttcatgcattctcttaacaaatggaatggcctgctttaaataatgtgaactttgaaaacagctaggtgttgttggtaagtctgcatataaagtctcaattcagtttccaaggtaattaacttattatataatattagtgaaaatattttaaaaccaatcactgcagtatgagtacagcaggtcttcaaataacgttacttcattcaaggtcgttttgttataaggttgagaaaaaaaaaaatcaattcccagccaaggccactgtctctgtgtagtctacacattcccctcttgtctgagtaggttttctctgggtcccccggttttctcccacatcccaaatctgtacatgttaggtcaactggcatgtatacacagtcccagtctgagtgggtgtggtgtgtaagtgtgctctgcaatgggatggtgtcccatccagggtgggctcttaccttgcaccctgtgctccagccatcagagaccctaagctggaaaaactggataaacaattatcttacttgtttttatgaaatctttctgaaacgtacatatagctcctatttattttaatgtgtaacattagaagtgtgctggtctttatttaggagttgagtgatgttctgtgagcagaaatatgctataggaacttaactcttgtttatatcaattagcctatgtatggtaacattggtttccttatacatcgtttccattcaagtcgcagtttccaagaacctgttgaggatgctaagtgggtgtttattgtacattatttagacaaagagatttaagaaataaaatctccccttctcaaagggaaacaaaaaaatcattttctaaaagaaataatgaatgtttctggtggaaaattgtaatgtaattttgaccccaagaacccagattaaaaacttcaattttagttctgaaaacttatgtttttctcctcatagctgacgtaggttaagaagcactttatacacatcacctcatttaatccttataatctcacatggtagaaatcaccccatgttcattttactgatttaaaaatgaggtttggagactttgagaaacttgtgctctgattaaatttgacctcagatctctgacttgaaactaatcttaatatcaataaatgagtcaagatttcaaggattgaaaaaaactgatagaatctagacttcataaagattctagtttacatcaagagtactgagagaactcaagacagtttctagttcacatctgctaaaagagaattcattcatctcctaggagagaatttccggatcatatataatattaaatgaaagagagttaaccataagaaatgaaaatatagcagtcctctcccattggttaattcttgaggaagattggatggaaaggaatcagggaggaagaaaaggcaggaagaagtaaagaaggaagggtgggaaaagcaaagataaaaagtccttgaacactgaataccttgattccacccaactttcaactggatacccagaaagaaaaagggctcagcatcttcttaccttaaattgtagagacagatttagtgctcctggccttagactccccattaaatatttaacagcttctacaataacaatcaattaatagcaggtagcccggaatttaaacataccttaaaaatgagctccgggtttgaagcagccacctcttcaatgtcgacgcccccctgggggctgcccaccagcacggggccattgcaggaccggtccatcagaattgccaggtaggtttctctggaaatatccaaggcttcagcaaccatcacctaccacattagtgggaaagtcaaattaattcagcattaagctgatttctacttggaaatctatacaaacttgctacacgaatcaaatggcttcattttcaggctcttacagcccagggagtgagtttgcagagctttgagagttctgctctcatggtgcacacaatgcccattttcacctccttaattttgatcccattaacttgttcgagtgacaggtatttcgtttgcctcaaggaaccttcccactttaatcttcttttttgtccttcctcaagaaactgtgtcacttaagaaataccctagagaagtggctgttattttaatttgagatattaacagtacacatatatattactacactgacttttctcagatttcactggtggaaaaccaagcatgattgccacagacggattcttttacagtatgtctgatgcttcatatgtttgtgtatttctgtctcttcgatcactatattttacttcattttatacttccttttaatttataaaaagaatatttgcttgttcaaaaataatgcaaacgataccaaaaatatataaatgagaaagtgaaagcagcttcctgctgcacagctctacctcaaataaaccctcgggccccaggagtcagggcagatacgagcctaccaggaacctccgtgataactagaaaaaggcaccccttcctctgggaatatgtggtcatttgccagggccatgactagacaggggacaagtgggatggaagaatgtcattcaattccacaagtgagtggggactcactgcctcagccaggtgtccttttgctctgtaggacttgaatttcatgtaacagccccaccaggaaaaaccactgctgacattctagtccttttctatgtatctgcaagcattgcagtaatggaataatcctacatgtggaagcacattatatacaacaggatgcctttcttttttttaatcttttttttttttaaaaaaagacagagtctcactctgtcactgaggctgtagtgcagtggcacgatctcagctccctacaacctctgcctccctgcaacctctgcctcccatgttcaagcaattctcatgcttcagcctcccgagtagctgggcttacaggtgcctgccaccatgcttggctaatttttgtatttttagtagagatggggattcaccatgttggccaggctggtcttgaactgctgacttcaagtatctacctgcctcagcctaccaaactgctgggattacagaggtaagccaccacgcctggcctcttttttaaaatcttaatactacaacttaaatatctttctaaggtcttctctcttcattgtgattacatggtatttatatgacaatatttatttaaccatgttcctgcatttatttatttatttatctatttatttatttgtttattcattttgagatggtcttgctgtgttgctctcaggctggagtgcaatggcacaatcgtggctcactgcagccttgacctcccaggttcaaacgaatctcctgagtagctgaaactacaggcacgtgcctccatagccacttaatttttgctttattttttgtagagatggggtcttgctatgttgcccaggctgatctcaaactcctggactcaagcaatacactcgcctaagattcccaaagtgttgggattacaggcatgagtcatggtgcctggcctgctgacagacatttacatgaacttcaattttcctaaaatgctactttagtgagtatttttgtacatgtatctttgttcatttcttttagtatccctgtagataagtatcctaaaagtgaaatgtctaggttttaaactgtgaatatttaaaatgttgataagtactgtcaaagtgcttgagagaggttgttccaacttacgcacctaacaagaacagtgaaagatatcttggatgtttaaagaatataaaaacaatcccataaataatcagtaatagatgtgaaaacaatgaaagcactaacattgcttttctttctttttttttttttttttgttgagacagagtctcgctctgtcgcccaggctggagtgcagtggcgcgatctcggctcactgcaagctctgcctaccagatttacgccattctcctgcctcagcctcccaagtagctgggactacaggtgcccgccaccacacccggctaatttttttgtattttttagtggagacggggtttcaccatgttagccagatggtctcaatctcctgacctcgtgatccgcccgcctcggcctcccaaagtgctgggattacaggcatgagccaccgtgcctggcctaattgttttgtatttttagtagagacggggtttcaccatggtctcaatctcctgacctcgtgattcgcccacctccgcctccaaagtgctcggattacaagtgtgagccaacgcacccggccacattgctttttttacaagtagtttagtgatgggttccacaaaaaaaagttacagattaagtagcattagattttaactactcagataccacaaaaacacttaagttttaggtcacatgaaatgggataaatatataatgatctaaaaagctataatggaatgaatatagaactcctctttttcaaacttttgttgaatttaccattagttaaaaataaaatatataggtcttcatattgatttatcagaaatggaagttcataagtatataaaaactgtttctcagcacatggtgttagaattagcacagaaccattctgatttcaagttggttgttctcaccaacaatgaaggtcaaaccatcagtcagtgcctaattctcccagtcttcaggttgcttgaaaccgtaaattctttcagaatttctgattgaggggtaggacaatatttgaagcaaaaatacttagccctattctttccttataaaatacagtaacaacttgtcgtttatagaaataacataaagtctgcctttctaagcatcaacattaatacaaacattttaagaaattaagataatcatttcttctaaaactttctctagaagagaaagctgttttaagaaatttgattggcacaaaatacaaaatgaggagtgtgtttggtatatgctttcaggtctactggcataatactgttcattttctaatgcagagttagtttagagaataatacttaatgactttcagtagttattcttagaggcaacacaaaattataactttttaggataagtgtcattcaagagtcctattcttaatcttcaaaaatgttgacagacgtgctctgtattccaccaaatttctatttgtgaagcccagctactgtctgaaacagctcttgcttcacaggaataatgcatgactctttaagaaaatgtcaccaggaaaatgataattatcaagagataattcaagaaattttatacaacaaagaccagtttgttgacatcgtcatgccttccaaatgaccgaggatgacagagtatattaggaagtgttacagagaaatctaaatggaatccacaaacactcatcccggagcaactccattagaaacatttcaaaagagcttcacctgtgagttacacaaagaatatgttgacacatcgtctttgtggagtccaccagtatagaaagctttttaactttctttgacctatctactgctgaatctgtttccttaaaaatatcatgctactggaattgtggtcaggagatgagtgctagcgtacaaactatttgtaacacacccatgaacagagaagattaaaagtacattctcgaattttaaattgattacagagcagtaaccactattggtactgaatcctggaccgcatgatgagtagcactgtctcacaggccctagtactagccccaggaatacataacacattggcacagacttagaaaacaaatatctgatgtgtataaatgtgtgtatgtgtttaaatagcttctgaaataaatttagaatcaaaaggttctataatctggggacttatacttttgagaagatggagtagacatgtttttccctattcttcccgctaagtacaaataaaagccttggacatatatatacataaaacttaaggtgactctgaaagttatagagaagaagggagactagctagggagcttgaggtccaaggaagcgtatggtagtgagtctcctatgttttctttggcctcataaatctcaggcagggtgctgggtgctagagaagccagcaacccaaaaacattaacaggcacagacaaataaatctccaggctcacatggtttcactagggaacttcaccaagcatttaaaaagaaatcaacaccaattaacaatgagcatgttggacactgaaattaagaatccaatgccacttgtaattgctttaaaagagaacaatgtatgtgtaagactgacaaaacatataccaaacgtatatgctgaaaacaatacaatgctgatgaaataaatcaaaggagacctaaaagaaggagagacatatcatactcatgggttgcaaggcttaacataacaaaaaaccaattccctccaaattcatatacaggtttaataagattcctatcaaaatcttagcaagattttttcgtaaagataaaattgttctagattgtacataaaaaggtataggaactagaacaggtaaaactgttttggaaaagaagaataaagtgacaagagttattctactcaatttcagaatttatataaatacagtaattaagactctgtgatattggtggcgggacagccacaaagatcaatggaacaaaacagagaaccccaaaacagacccaaagaaatatgcccagctgaattttgacaaagatgtaaaagcaattcaatggagaaaagataagccttttcaaaaaatggtgcaggagtaattgaatatcatagcccttttgccccttaaaaaataaccttgacctaagtctcacaacttattcaaaagtcaactcaaaatggatcacaaacctaaatataaaacataaaactataaaacatctagaaaaaaacatgagaaaatttttattatgtagggcaacgtaaagaggacttagacctgatactaaaaaggtataatccataaaggaaatattgacgtattggacttcatcaaaattaaacacttttgccctgcaaatgaccctgttgaaaaaatgaatatatacgttatatagtgtaacagataatacttacaaagcacatatccaacagtggactagtacctagaataactcaaaactcaatagtaaaaacataatctaattagaaaatggccaaaagaaatttgctttgtctcttcatgctgctgttacaaaatacctgagatttggtcatttataaaggacaaaaatatattgtttcacagttctggaggctgggaagtccaagatcagtgcaccgccatttagtgatatggcctttcttgcttcatcctcacatggcagaaagtggaaatgcaaaacaggtctaagctagttcccttcagcccttttataaagcactaccagggatgtccaatattttggcttccctgggccacaatggcataagaaggattgtcttgggccgcacataaaatacactaacactaacaatagctgagctaagaaactaaaattgcaaaaaaaatctcataatgtttagaaaggttacaaatttgtcttgggccactttcaaagccatcctgggatgcctgtggcctgtgggccgtgggttggacaagcctgcactaatccattcatgagggcagagccttcatgactaatcacttcccaaaaggctctgcctcttaatgcaaaccacaatggggattaaatttcaacatgcattttggagggagcattcagaccatagcatccatgaacagacaattcaccaaccacaatctacagatggcaaataagcacatgaaaagatgttcaacatctttagccattagggaaatgcaaattaaaatcacaatgaaatatcactacacacccataagaatggctaaaataataccaccaccaccaaatgcgggctagaatgtggagaaccctgaccacttacacattgctgatggcaatgtaaaatggaacagccatgctggaaaacattcatcagtttcttaaaaaaactaattatacaacttccacataacccaacaattatcccccaaaatgaagatttatatttataccaaaaacctgttcatgaatgtctagagtggctttatttgtaatagccaaaaacgaaccaacccagatgtctttcaacagatgatggttaaacaaactgtggtaggtacatccatatcatagattgctacatagcaagaaaaaggactgtaacgggattattacacattgtatgcctatatcaaaacatctcatgtaccttataaatatatacacctactatgtacccacaaaaattaacaaaagaaaatggaactaaatactgataaatacaacaacttaagagttttccacaaaactctccctgaaaagtaaaaacaggatgtcaccactgcagtgtcctgcagcatggtgcattggtagagaccactgatctgtgacgctatgtcaacagagcagacagctgccaccccaaaatgcaggaccctaattcgctgttaggacaggatcttctaaccatggatgcttttcagggctgacacatgtgatctgtgtagttgtaaagggatttaatgtttagctatagctgtcttgaaattttaacacgggtccctgcctttttatttggcactggattctgcaacccaggtagctagttctagtgtctggatacacaaaagggatggtgaaaggtagattggcaggagggagagttaggttctggtctcagctctaccactcacaatttcatgactgaggcaggccactttcctctgggctttattttctatgtgtggatgaggggtgtgtgtccacatgctatacatacttgggtacttcagctgaccttcctaatgcaatatacccccagcaataaaaatggctcaaaattacagtcatcctaaaataaggaatggggcatttagaaaaacaaccacaataggtaattctgacagacacgcctggggttgagggccactgtgtgggagcagcgaatgtccctcactgagtataaggctgtcacagcaagcgcttctcaactaaatagaatgcatctgtgttctcagagggaaagccattgctcggtcactcaccctcacccactttttgctaaatgctaatgataataaataatattactatcatagagccctttttatttctcctccaagacatactacttactaaacagattagatgagctttaaaaaataaaatggcacactgccaaagagcagtacttcattagattctgtcaaaaactgaaggatggttttcttttctattttttaacacatatatagaaaatgacccaaagtatccatattaccttgttaactttcacaccttcttttggagtttgttttgtcgctagattgtacccaatcatctgtttagccagctgtcccacaacattagggctaagagaaagagaaaacaagcagaaaatgaatgtttgttgaaaatcatttaaatgagagtccttacacagagcctcatgtctacactgcaaagggttcaccttcaccctcacaaaatccatgagtctttctgcttatgtgctgcgtgtttagcactgtactagaggctcactgagagcaaaataaaagtgagttcatgaatgaataaatgaaacaaaagatgctttgtgacctcttcacccaaaaaagttacagtcatagtaaagagagaatgctgaaatgcacaccagattcagataagggttgactgaagatccgacagtggaaaactggggagatattgaacaatgagagggaaaggaagagggtaaagatcaaagtaaatagtaaaaaggtgtgtgacaggaacagggaggagaggaaagtgttcagtgctaggagatgcaggagatgaagttgaaaagacaggctcaaataaaggaaggcttggactatcagaggggaggtaccccagatgccactggtaatggggagtcccttcaggtccttgaatagaggagtgacattatggaagtagcatttcagttggaagtggtatcatttccaacatttatgatgaatcattgattgtttaggacagaaggactgtcaagttttcaccaattagtaagaaaaatcattttgtgggggcagaaggaaaactagggcactgccagagccctctacctatgatttcagtttcttctagttgctttggcccgctcctaccccaccacaaccaacctcagtgtgcctttcaatcttgagcaagatcttccataactgcttggccaaaagacaaggaataacaacctccagacttactcttttgttaaatgaacacctcctttcaaaccactattgaagacaccttttcctcttcctccagctaagatctgggcttttaaaacaatttcttttgcatctgaaaaagaaaaatccagagttggtagctgattttaaattctttttttgttttttaagcaataaggaaagcaataatggcacataacttccaagtaactggtaaaagctctctcaaactaactttgaaaataaatgcaatgaagaacttcaaaaaaacatctatgagcctaaatacaaagcttgtttactgaggatattcaaatgcttcctaccagtttaatcatctaatacttgaccttcccaagggaaagcaagacatgtgttcccttgctcttttgagtgtgtcagaagaagctaaataaatcctggaaggaggtattaattttactgtgtaatggcactcccatgtggcagaggcaccagttggccagtaagaggagctaaccatcagagatgtcaaagggaagactggattatgcgggggaaggtttaaagacaagacacaaaggtcatagttaataactgcattattggaaaccaacagttttctgagcagttgttctatatactgatagggttgggaaagggaggaggaaatggattaaaactaaaagcaagcaatattttaaaatcattggcaaggtaacaaaatatcctgggggaaagtggttgtggaatctttgtttctcatcacactccacgaatgaaagaactctctaatcttgactttttagacgagagttattaacacaaatatcttcccttgcagggaagttgggtgcatgaagtagcccagtgacaaatggggcctttagcaaacagggtagctcccctccccaaccaccaaaacaaaacaaaacaacaacaaacaaaaaactgcctccaaatcaaatatgtttaataaaccaaatagcacacaactgcagaccacagctgatatcctctgtttgtgagtcatctttatttaaaatcacagaacccagctgatcccctataaggccatgagagtattctggttcagtataccagatttagaatctgcaaacccaggtttcaatctggccttcatccctcacccagctgtgtgacattaggcaagttacttaatgtctctgaaactcggtttattcaactgtgaaatgatgacaagggttgttttaaaaattaaatgaacacacatgaatgctttatcccagagcctgaaaacttgtgattaattaaaaactattgcctcgaccagttagttcatttattacctttgtatattgtaaagaatgaaaggaatcattacagagatggctaaaccaaaaaactaacaagcgctccattaagtttggttatttcagctattactgtcactgtcatcatcattgttacccacaggcaagcaggtaaaggttcaaacggaaagagctgtggaaggttttatcatcaaggcaatggggagctacagaagtattttacagaaggcattcagccagctgatgtcacaccattgaggctccttcactgccttcattggttagtcttcttgtctcctatatttgcttacactcagaaagctgaagcccaccttcttctcagaagcaaacacagttttttcttagaaggctgtcctgtgtaccctctggcaataatttctgccctggatacgaaccatcacaacattggtcaagccctgtcttataataaactggtttccatcaagctgagtagaagacaaattaattgtcagaaactcacaaggaaagcaaccaagtaaaatgaatacattgcatatttagcttactgcaagaacagtagtaagagcaaggatattggagttaaacagacctggttaaaatctccaactctacctatcactttctttgtagagaagaaacaactgagattcagaaaggtaaaagtagcatgcccttctgtaaagtagtcatattaaagaagtctacagtgtaaggatgatgtgaagaataaatgaaatacagtaaagtgcctggcacatttttttaaagtcaaaatatgatagctatcaacattataataattttcagcaattaagaaaaaatggcacacaggaagacatttcctgtttttctttggaagacatcaagtggaaaaaatactttttgctgtctactcaaatttttaattgtgatcacttcaaattctttacataactggcattccattgccattatcatttttcatatccttgtcatcctgaagagatgctttcctctctgagctttccagcagcaaaacttgaaagccagagagaatacctaattgggcattgttaattggcactacataggcttgattagatcagctttagtcactaaccatcaagacacagaaagagttgtatcctcaatgaagtgttgtcaattaaacgtgtcgccatttgacctccagtcaaagtattccatgcaaaacagtgttggtagaacaagcaaccagttcagagactatgaaaccagagatcaggacaaatagaaaaagacaacaacctacgcacatctgcaacatacaccccaggccaaaaatgagttcactaaaatcatctcttctgattacatctcaagtgctaaatcaatatagtaagtcagcaagtcagcagcccaaagtaaagcaagtttttctcatcttgagaaaaactctcatgaagtaatttaattcaaggcttatttactcaaggtgctgaaaattaagatgacaaatcccactcaacagtaactcgtctcttcattcagtatttaccaaattgattcacatgtactaaatgtcactgtttctatttatttaaagatctgatctctcccaaaactcaaatttctgtttttatttaacattgcctcttgccccaatcctgaacggtattagaaaagaaaaaaaaatcccatatatgaaatgcaatttttgtctgaataagacgacttaaccatcctttagaaaaacaagctaaaaggacagaggaaaaaattaactctaatatgagttggggttttatttttgttttttgttttagacagagtctcactttgtcacccaggctggagtgcagtggtgtgatcttggcccactgcaacctctgcctcccgggttcaagcggttctcctgcctcagccttctgagtagctggggttacaggcacatgccaccatgcccagctaattttttgtatttttagcagagatgaggtttcccatgttgctccagctggtctcaaactcctgagctcaggcaatctgcccacctcagcctcccaaagtgctaggattacaggcataaaatagattttatatagaagtagacaacaacctagacattgataattatattattggactctgagttggtataacttgggtctggataactccaaagtctttgctcttaattgctatttttatacgcagtagcctaagtatgcaacgtcttcactaaattttgttcctttcttagtgagtttctgaaaataaccagtactcatggttaggttttcactcagtttaataggaaccagtttattagaatttacatatattttagtagaaaacactgtaagacatatctgacaaacttataaatatgtaagactctcaaacacagtatcacttaagagaacaatatttagagcgatttaaaaagtctaagcaaaaccttactctgtggtctttttttagtctatcagctgaattataacaatgcttttacaaatattttcttttcattctttaccacaagtgttattctaattataatgcagttttatagcaatttttatagatccccaatagtcacatgctagataataaacattcttggaagcagtaggtctaaagggaaaaaaatcaaatcattaagaaaagcataatctaaatagaatacacatttttaattaagcaagctttgtaaaatgtggttcacttaattttcttagagatggctttctgaaaacatatttacacaaagtaatgctcacaagacatatttcagagccataataggaatcatagtaaatgtctgaaatgttaatcaaatatattgacaaaagtaagttattttcaactattttttaaaaacagttcagtgatgagtcaactatttgtgttactgagctggtttttattcagcattgctcttttctaaattataatactttcctaaatgctaaatgtatcactgatactgcaatgagatgactactacaatgatcatctatttggagtcaataatattggacttgcagaaactgatttctgtggttcactgactggagcaaaattggaatatccagttctcagcacaactgcatcgtgtaatatgtagcatggcaatcaccttccctgagagttgatagaattcctaattgagaaagttaaattgtatttcagaatttcagatttacctattaccagaaggcaaggagaaggcaaagtggaaggcaagagaagagtcaaaaggtattgtgtaaagatgaactttaataaagaatatacaattatatagagataagttagaggccttggtgccaatttctcaaaggaaatgagctcacttctatgtttgcgttacgacttcagaacccaaacataaaaatagagagttaccaatcttcaatcattactatgatatcacctatagaatgacacatatttcctcaagttgtaactgggtcaatgggaataagatgatactgtaataattctccatatgtcaaaaggcatctttgagactgaaataattatttcagctttcaacatgtctgacatggacttttcaaatttgggacagagagtttcaaacacacagcacattagaataaaccatttcaccattggtcacatcatttgactgaatgagactggagatacatggctctccagtagactgctgcccatcagagatttgaatcgtgtatgtctaaaacagccactttcaagtataagtacaagacagaaatagaaccatctccaggacaaggattttatgatacaaataggaagttatccagggagatattatttcaaatcaagaaattcttgactgataaggctttcatgtaagttttaaatctaaaacttccctttgaatatgattccctattatgaaaaaaaatcctttctttggatactgtgggggcatgataaagccattttgaagagtttgattatttaaaaatgataatatcttaacaaaaaatgtatttatgctttcgacggaataattttaattttagtccctataaaaattcctaaattaaagtttattaaatcacagttttttcatatttgccatatgcttaaaaatattgtatatttattactatattatgggccacattaaaatctgtaatataaattaggctactcctctgatcttgtcactaatcttacttactgctttcataaccgttaatacacattttgttggtgataaaatttttaaaggtaaataaaaattatctctagaaaaacccaattcagttgtaacatcttactattctcagtaaaagatacaatcttgctcttttcatgtagtttaatactagtaagccaatcttacattgtgtcaattatattaaaagatatatttctacaaaaaagccttaggacagaactccctaacactgatggcaaaaaaaaaaaaaaaaaaaaaaaaaaaaaaaatgcccatgtgacatcattcaacacctgtaactaattaaagaatttctaacattgtaagaatgaaaccacaggacattaaacaaatcttttgcaaatgaagccacttgaagaaatgacagtttttcagaaaaatacaagtttcttcaaaagaacaaacttccagaagaaatctctactgattaattacaggacaaagcaatcctattatgatatacattgacagtaaaaatacctgtgtaacacttgtaatttcaagaggtgctggaaacagtcatggaagatgaaaagcatttatgaaagccaaaagtatttctactgtattatgtgtatgtatttaaaggaagttaaggaaaactagctataaaaaaatcatgtctccccctgattttcaaacgaaagatgtgagtcagccagggttcaattaaggaggcagaactactatgacttatagacaagggatttattataggaatcgaagcttgcacacttacaagaggagctgagaaaaggcacgtctaaaagtgaggttggagggtcctaggagtccccagccagccaagcagaggaatcagcacctccagatggagaagtggatggcaaaggaggagctggggaaaaggacttgggacttgctgccaagtgctacagtttggatgcttgtccccacaaaatctctcgttgaaatctgacctccagtgttggaggacaggcctaatgggaggtgcttgggtcacgggagacgatcccttatgaatagattacctggaacttaaaagaaaattaaatttaaaaataaataaataaatgaattacccatcctcaggtactcttttacagcaacactaaatagactaagacaccaagcatctcaggatgggcctgggtccatatggctcagcaggatcagcacttgggacaaacagctggacacaatgcagagaagagcaagaaaaggctggagcctcttgctaacatctccacatctgtctgtcactacctaatcacaatgaactgcagggagtaatcacaaattctgtgcaaactcctcttttagtcaactcaaacccaaaactacacagggaaggggattctggaaaacgcagttccagctaaacaaggtgacacagtacaagtcatcacacctgatagctataacatctgacagcagagcccacaagtgttgcgggttgaaaatgaacagctctgaaacgtttctgagttgcttgagaatccacctctcctttagttgcatattattgaaggctacttgacattaaggggattctctcgtcgaccataaccagtgatgaggaagggaagaacaaaaggtggcaacagccagaacagctcttggtgtgcacacactcatatcctgctggtggaacataaactcatgaaggtttcattttcagagccaattggaatgaccatgaaatttaaaatgtatgcaatatatacactgtctggctgcacctatatttaaagatgttcgtttcacttttacagcaatattactaatttcagagatcatctaccttcttgaatagaaatcttgtattttccttattttctgttatttaaatctgttcctctctcagaccctcctccattggtgataggcgccctcacaggcaatcacaactactgtccagaatctttgccctgctgtctgttcactgccatcattcactgcctatggtctctggaccatactcctgccagttttcacactaaacctgagacctctgtgcctgcaaatcaccaagccctgctgcccagtcgtcttcttctcatttagacacatcatccatcaggaacccttcacctctccaacctgttctgctctttagaggaactcattctccagacagccaatgcagactgaaatcaaactccctctcacagactcctgagcccagtacaaatcaaggattcaggctgggcaacttatttcatacagctgaaaaatgcacaacagttaaaaagtacctggaatctttgaaggcaattaggagggccatctgcttagggctcacagaaaatcctttgatagcgcaatcctacttccatgaaaattgacaagagaactaaagattttcattgcaatgtagttataatagtgaaaaaactagaaataatccaaatgtccaccaacatttggacactattgggaaaataaattttatgtatccaaataatgaaacaataaaacaccatatgtacagtcattaacaataattaagtatactttttaaaattatactttaggttctgggatatatatgcagagcctgctggtttgttacataggtatacatgagcaatggtggtttgctgcacccatcaaccagtcatctaccttagatatttctcctaattttctgttatttaaatccgttcccctctcagaccctcccctacccccaacccaccgacaggccccagtgtgtgatgttcccctccctgtgtccatgtgttctcattgctcaactcccacttatgagtgagtacatgcactgtgtggtttactgttcctgtgttactttgctgagaatgattgtttccagcttcatccatgtccctgaaaaggacatgaactcatccttttttatggctgcatagtattccataatttatatgtgccacattttctttattcagcctatcactgatgggcatttgggttggttccaagtctttgctattgtgcacagtgccgaaataaacatacgtgtgcatgtgtctatatagtagaatgatttataatcctttgggtatacgcccagtaatgggattgcttggtcaaatggcaatttctagttctagatccttgaggaatcgccacactctcttctacaatggttgaactaatttacactcccatcaacagtgtagaagtgttcctatttctccacatcctctccagcatctattatttcctgactttttaatggttgccattctaactggcgtgagatgatatctcattgtggttttgatttgcatttctctaaagaccagtgatgataagctttttttcatgtttgttggccacataaacatcttcttttgagaagtgtctgttcatatccttcacccactttttgatgggtttgttttcttctttcttgtaaatttgtttaagttccttgcagattctggatattagccctttgtcagatggatagactgcaaaaaatgttctcccactctgtaggctgcctgttcactcggatggtagtttcttttgctgtacagaagctctttagtttaattagagcccatttttcaattttggcttttgttgctattgctttggcgttttagtcatgaagtctctgcccatgcctatgtcctgaatggtattgcctaggctttcttgtagggttttgatcgttttaggtcttatgtttaagtctttactccatcttgagttaatttttgtgtaaggcgtaaggaaggggtccagtttcagttttctgcatatggcttaccaattttcccaacaccctttaggaagagggaattctttccccattgtttgtatttgtcaggtttgtcaaaaatcagatggttgtagatgtgtggtgttatttcggaggcctctgttggtctatatctctgttttcgtaccagtaccatgctgttttggttcctgtagccttgtagtgcagtttgaagtcaggtagagtgatgccttcagctttgttctttttgcttaggattgtctttgttttaggggccctttcctggttccatatgaaagttaaagtagtttttactaattctctgaagaaagtcaatggtagcttcatggggatagcattcaatctataaattactttgggcagtatggccattttcacaatattgattcttcctatccataagcatggaatgtttttccatttgtttgtatcctctcttatttccttgagcagtggtttgtagtcctccttgaagaggtccttcacaaaccttgtagttgtatatctaggtattttattccctttgtagcaattgtgaatgtgagttcactcatgatttggctctttgtttgtctattaatggtgtataggaatgcttgtgatttttgcacattgactttgtatcctgagacttcgctgaagttccttatcagcttaagggaattttgggcagagacgatggggttttctaaatatacaatcatgtcatctgcaaacagagacaatctgacttcctctcttcctatttgaataccttttatttccttcccttgcctgattgtcctggccacatcttctaatactatgttgaataggagtggtgagagagggcatccttgtcttgtgccaattttcaaaggaaatgcttcctgcttttgcccattcaatatgatattggctgtgggtttttcataaacagatcttattattttgagatatgttccatcaatacctagtttattgagagtttttagcacgaaccggtgttgatttttatcaaaggccttttctgcatctattgagataatcatgtggtttttgtctttggttctgtttatgtgatggattatgttaattgatttgtgtatgttgaaccagcttggcatcccagggatgaagcctacttcatcgtggtggataagctttttgttgtgctgctgaattcggtttgccagtattttattgaggattttagcatcgatgttcatcagggatgttggcctgaaattttctttttttgttgtgtctctgccaggttttggtatcaggatgatgctggcatcataaaatgagttagggacgagtccctccttttctattgtttggaatagtttcagaaggaatggtaccagctcctctttgtacctacggcagaagtcagctgtgaatccatcttgtcctaggctttttttggttggtaggctattaattactgcctcaatttcagaacttgttattggtatattcagggattcaagttcttcctggtttagtcatgggaaggtgtatgtgaccaggaattcatccatttcttccagactttctagtttatttgcacagaggtgtttatagtattctctgactttagtttgtatttctgtgggatcagtggtgatatcccctttatcattttttattgtgtctatttgattcttctctctttttttattagtctggctagcagactatctattttgttagccttttcaaaaaaaacagctcccggattcattgatttttttaagggcttttcgtgtctccatctccttcagttctgctctgatcttagttatttcttgtcttctgcttgcttttgaatttgtttgctgttgcttctctagttcttttaattgtgatgttagggtgtcgattttagctctttcttgctttctcctgtgggcatttagtgctataaatttctctctaaacactcactgccttagctgtgtcccagaaattctggtacgttgtgtctttgttctcattggtttcaaagaacttatttatccactggcttgaaattcacaccgccagcacatcagtctgaagtccacctggggtgcttggtgggaggaggggcatctgccattactgaggcttgagtaggtggttttcccctagtagtataaacaaagctgcttggaagttctgactgggcagagcccaccgcagcgtggcaaagtcactgtagccagactgcctgtctagattcctcctctctgggcagggcatctctgaaagcaaggcagcagccccagtcagggacttatagatcaaactcccatctccctgggatagagcacctgccagaaggggcggctgtgggcacagcttcagcaaacttaaaagttcctgcctcccggctctgaatagagcagtggatctcccagcacactgctggagctgtgctaagggacagactgcctcctctagtgggtccctgatccctgtgcccccttactgggagacacctccagcaggggtcgacagacacctcatacaggagagctccggctggcatctggggggtgcccctctgggacaaagcttccagaggaaggaacacacagcagtctttgctgttctgcatcctccactagtgatactcaggcaaacaggttctgtagtggaccgccagcaaattccagcagaaatgtagactgtagcagaggggactgactgttagaagaaaaactaacaaacagaaaggaatagtataaacatcaacaacagggacatccactcagaaatcccatccaaaggtgaccaacatcaaagaccaaagttagataaatccacgaagataaggaagaaccagtacaaaaaggctgaaaattccaaaaaccagaacacctcttttccttcaaaggatcacaactccttgccaccaagggaaaaaaactggatgaagaatgagtttgatgaattgacagaagtaggtttcagaaggtgggtattaacaaactcctctgaactaaagaagcacgttataacccagtgcaaagaagctaagaaccttgagaaaaggttagatgaattgctaactagaataaccagttttgagaagaacataaatgacctaatggagctgaaggatacacaagtatcaatagctagatcgatcaagtggaagaaaggatatcagagattgaagatcaactcaatgaagattacagaaaaaagagtgaaaagcaacaaacaaagcctccaaaaaatatgggactacgtaaaaagaccaaacctacgtttgattggtgtacctgaaactgacagggagaatggaaccaagttggaaaacactcttcaggatgttatccaggaatacttccccaacctagcaaggcaggccaaaattcaaattcaagaaatacagagaacaccacaaagatactccttgagaagagcaaccccaagacacataattgtcagattcaccaaggttgaaatgaaggaaaaaatgttaagggcagccagagagaaaagtcgggttacccacaaagagaagcccatcagactaacagtggatctctctgcagaaaccctgtaagctagaacagagaggccaatattcaacattctttttctttttttttttttgagacggagttttgctcttgttgcccaggctggagtgcaatggtacaatcttggctcgctgcaacctcctcctcctgggttcaagcagttctcctgcctcagcctcccaagtagctgagctgggattacaggcatgcaccaccacacctggctaattttgtattttttagtagagacggggtttctccatgtaggtcaggttggtctcaaactcccaacctcaggtgatccacccacctcagcctcccaaagtgctgggattacaggcgtgagccaccatgcccggccctcaacattcttaaagaaaagaattttcaacccagaatttcatatccagccaaactaagtttcataaacgaaggagaaataaaatcctttacagagaagtaaatgctgagagattttgttaccaccaggcctgccttacaagagctcctgaaggaagcactaaatatggaaagcaaaaacccggaacagccactgcaaaaacataccaaattgtaaagaccatcaacactatgaagaaactgcatcaactaacgggcaaaataaccagctagcatcataacaacaggatcaaattcacacaaaacaatattaaccttaaatgtaaatgaggtaaatgccccaattaaaagacacaggctggcacactggataaagagtcaagacccatcagtgtgctgtattcaggagacccgtctcacgtgcaaataggctcaaaataaagggatggaggaatatttaccaagcaaatggaaagcaaacaaaagcaggggttgtaatcctagtctggggtaaaacagactttaaactaacaaagatcaaaagagacaaagaagggcattacataatgataaagggaccaatgcaacaagaagagctaaccatcctcaatatatatgcacccaaaacaagagcacccagatgcataaagcaaatgcttagagacctacaaagacacttggactcccacacaataatagtgggagactttaacatcccactgtcaatattaggtcaatgagacagaaaattaacaaggatattcaggacttgaactcagctttggaccaagcagacctaatagacatctacagaactctccacccccaatcaacagaatatacattcttctcaccaccacattgtacttattccaaaactgaccacataattggaagtaaaacattcctcagcaaatgcaaaagaatggaaatcataacagtgtctcagaccacagtgcaatcaaattagaactcaggagtaagaaactcactcaaaatcacacaactacatggaaattcaacaacctgctccggaatgactactggataaattaagtatatttttaagtgtaaatgtcagaaaatgcccatgcacaaactaagctttaagctgaccttaatgactagcattttttaaaaaatacacctgtaaacagttacatagtcgtaataaaatctaaataaccaaggttgggtgtggtggctcatgcctgtaagccactttgtgaggccgaggcaggtgggttgatttgggaggctgagacaggtgggttgcttgagcccaggagttcgagacaagcctgggcaacatggtgaaaccctgtctctacaaaaagtacaaaaattagcctggcatagtggcatacctgtagtccaagctactcaggaggctgaggtgggaggatcccttgagcccaggaggttgcggctgcagtgagccatgattatgtcactgcactctagtgtgggcaaaagagtgagaccctgtctcaaaaacaaataaataaatgagcaacaaccaaactattaactgaggttaccttaagtggctagggagtagtattatgggtacaacattatatcttttctatgttgacttaattattttgcaattatgtgtcagaaaaataaaaagagtttaaaagctgtgaattaaatgtgggcagttaattcatagtagtttgtcttgaatatttaaatactcatttctgtatcagcctttaccattttaccacatggggtcggggtgtttatatttgaggaagcctctagaagatatcttaaggacacatggctgaataccttataacatgacctcctaaagagtcacgcaagaaaactgggagtggcaggaaaatgttttgcccttttaaaatattagtgagcacttacttattctatgggaattcaaaaaatttttttaaatgtcatggtcattgccttttgtaaacttaaaattgactggaagaaatagacacaaacaaattactgaaaatttttaatttataataagcattaagaagcaaattaggaaggggaaatggtgtcaagtaaagctgagaaggaaaaaggacggaagaactattgatatggtttggctctgtgtccccacccaaatgtcatctcaaattgtaatcccctgttgtgaagggagggacctagtgggaggtgattggatcatggggatgatttcctccatgctgttctcatgatagtgggtaagttcttacaagatatgatggtttaaaagtggcactccccacttcactctctttctctcctcccagcttgtgaagaaagtgcttgcttccccttcgccttccaccatgattgtaagtttcctgaggcctccccagccacgcggaactgtgagtcaattaaacctctttcctttataaattactagtctcagggaagcagtgtgagaatggaccaatacagctataaagagaagagtacttggccaacgtcatgaggaagagctgtgagacttctaggaagatgggactggagagcaaggacatggagtgaaaaacaactaaaaaaaggctactttgcttttctatttatttctgtttggctttcatggtttgctgtttaaactagaaatcactatagcaccacttcaaataaagcagcaaatcatgccaggatcctgcactataaatcattcaaatttgctatttcagatattcagaaaacttctacagattaaagtttatttccctatgttcaagaacagcatataaatagaaaatacattgatcatctttgttaaatttagatattttaccccaaatacttttaagagctctaataattttatcatgccagtctcaaaacagctcccaaccaggtaagctaactctcagataaaacagcccccagccaggtaagctaactctcctataaaagttcctcaaggggtcagtgagattcatactaagcattatttagtagcaacaataataaagtatacgctcccctcctcccatcctgcaaagaaacacatattccatactttaaatctgctataattccaaatgctagagatacagaattccagacaacagcttgatgttgttgccataaaaaggaatccaggaggcatttgtcttcaattttaaagtttgtaaagtggtcaatgacatgctggagttaagcagaagccaggaatgacctaccccaagagagatgaaagatctcagaaccactttcccatgatacacacatctactgaggtccagcataactgttatgctgctttcaaattgcactgagttttaaattgcaatgtcttgctcttttattgcctgtcttgatgcattcattgtttttgaaatctaagtctattgctcgaatgttaaacacagaggggactttagattacatcctggaggatgaaactgagcagtatcaatgaacttggaagagtttatatttggctttcaagggttgtgaaggcctgagaaatagctatttccttttctctttatgccactttctttggtttcctccttctctccttccctgcctcatgctttcttcctttctccctcctccctcctttcctctctccttttcattcttccttttcccacctgcttccctgcaatacttccaagttatttaatttgcatgtttgactatatctcagataactaatttcagttccagcagccagagagatccacatttacttcaaattctaccctccattacactctcccacagaaccactcccaaataagaatgtatccacttaaatccctgtgaattggaacactcattatcaatgtgctacacctaaccacagaagccataaaacctgaacctactttcttggactgttttcaaaacgacatttctgattatatgtgagcattcaaatctcttctggcactttctgcatcttatttttcaatgcctggcttgagctagaattcatactgggggaagtcaggccaagtgttataaatgggaaatgagggaattaacaagctggtataaattttacttcttggagtaaaagaatacaaaattttttgacttgagtttggaattataccacccaagacagcacaggaaaatacttaagagctagcatccatatctggtaaaactgaaataaaatttggcagcttttaagtagttctccaatggtattagtgtggcacagaaatcaagtcctgtttcatatgaaccaagcagtcctacaggaggataccctttgaaattccaatcattacaagaaatttgcactaatgattcatatttcaggccgggcagggtggctcacacctgtaatcccagcactttgggaggccaaggcaggtggatcacttgaggccaggagttcgagaccagcctggccaacatggtgaaaccccgtctctactaaaaatacaaaaattagccgggcgtggtagcacacgcctataatcccagctactcgggagactgaggcagaagaatagctggaaccggggaggtggaggttgcagcgagccgagattgtgccactgcactccagcctgggccacagagtaagactctgtctcaaaacaaacaaacaaaattagctgagcatggtggcaggtgcctgtaatcccagctacttgggaggctgaggcaggagaattgctggaaccggggaggcagaggttgcagcgagctgagattgtaccactgcactccagcctgggttacagagtgagactccatcccaaaaaataaacaaacaaaaaagattcatattgcatcatcacagctggaaagctagcatataagtctattcctcctatccacacacagcttgctaatatggctaatgttttttctatacccccacattctctgctatggtctgaatgtttgggtctcttgtaccccaaaattcataagttgatatcctaacccccaggtgatagtactgggaggtgggggcagagacctcctgcatgggattagtgcccttctaaatgggaccccagagagttccctcatcccttctaccacgtgaggacacagctagaaggcaatatgtgttaaggagaaagcaggctcgcctcagacactgcatcagccttggtcttagacttcccagcccctaaagctatgagaaacaaatttctgttgtttataggccacccagtctctggtatttccttacggcagccagaatgaactaagatactccctgaacacatagtgttttactctattttctactttagttttcagcaacatggacatccagaagtaaacaatacatctatagaattacctgaaatactctccttcgtcctcaagcactggtgcccttaaatccagctgcagcctcttccaggttcctgaccctttctcattgcctcccagcaggaggtggaacagtctgtcataatgcataaacatgatttgactgtggggagggggcagatcttgctaccctagaagaatttcccaggatacctgtccaaaaagctaaaaacagaataactccagaaaagaagatgtcctagccttatgcaaagggaacaattttcacgaatcaactaaattaacactgacttgggaatgctaccaagtctaacaaagcagatgccacctctcctctgaaggcccttggagttcaaaggagatgctacagcaagggggatccatgaagccagggagagattctgtcaaacctaatgaagccactctccagttttgctaatcacaccccttacaccgcctccagtatgaaagtttctaccgaaggacgacacagcatgatgcaaaacaaaatcgcctcattctcctgaaaatgaccagtaccaggcacatagcaggccctcagcatacggtcattcattcacaatcatcacttcctttactctatgaaatcataatcacagtgtttgctaggagcttactgaaaaataagatttgtgctgagcgtattcactatttctatttagcaaatgacccaattgaagttaagggagtttcctggagtcatacagctaggaagaaacagagttgagatttttaagccagaaagattatttgagagactgtgctttaacttcctcacatagagccttattactgatttttccccaatgttctattattaaaatttccaatcacatagaaatgtcaaatgactagtaaatatccacatataacctagatctacaactgttcacattttgtacatgtgctttgtcacatctctcaatccagcacaacccatcttattttttcatgcaattcagagtaagttccgtgcatcagtacagttaaactcttcagtatccatatcagttattagagtttaaaaatattagagtttaaaaatattaatttataataaacattaagaaccaaataaggtacagttcctttggggaagaggtaaaatttaatttcagtgaaatacccaaatctcatgtgtaccaatcaataagttttaacaaatgcatatacttgtatgactcaattcccaaatcaataaatctattattgtttctgagaacatattacaagagtatccttaggacaaatgagcgaaaatattgacaatagggatcacaagtctcttcctaaatacttactgagactaagcataacaaaatatttaatttatacaccttagcacaaagcgcaatgtccaatgcctggcctacaagaggcacccaacaggtatgagactatccaaaggcgtataaaaaaggaatcagcttcccccattaccacttccaaatcagaatactgcttgaaacactcctaaatcagtcacagtcaattatatgcaaaatactgagttcaaatgggaattttttttaagccatgaacatagtaactctttagaaatagaaacaattcattatttatatataagttttttatagtaatgatgttgtgtaagctcagtggaaattatcaaaaatagctgcatccacaagtttccttgcaccacgcttgcccaagtatttctgtgtggctcttccattttcaacaagggattgaattttcctggaaatacttgcaacctccagaaaagccaggatgatacctggagcttaagactgatacttaagcaatgaagtgacgaaaacgactatctttaaccaaaagcttttctacgctatcaatgtcactgtcacctgcctgaagcttaacatcatgggactccagacttttgataagcctgcaggatttttgaaaggaaaccaccagaaagtacttagaagataaaagccaaaacatatctgtggtacaaactagagtacattactttttgcaaactttagaaaatatagacacaaatgtctaaacaaagtctgaaatgatattaatataaagcccacatcaacagtggttatctatagggaataggggttgatctttacctccttctttatagttttgttataatctgcgttctttacaatgactatttataatgagagaaaaactattttcaaatttaaataaaagatgtttctttgacctggtaagaggagtaacagtacattgttatgagggggaaaagcttagcatagtgcaaaatatataccactaaatatatgtacatatacaaatctataactgaggataaatctggaatgaaatatgccaagatattaactctgattactggtagagaaaggttgtaatggataaattttttcttttttttttaaactgcaaatttgctacaaggaacgtatattgtatctgcaaatggggaaaatgacagttatttttaaataagcttattacgtattagattaaatcagctgcctgagatgtgtacacagacaccattcagctctactgggcttaaaccacttcttcatttcatgggaggagtgactcaaaataaagtaacgggcaaaattgacacttctgaattcagctgctaatcctctgattgaacaccagccgtattcttccctgggcctggggcacatacatctgcacttgccagaattagctgacctgctccatgcgggtaacatgattggtctctgtgagactcaggccacattactgcatctcaagtcattgactcctttcgtgaagcagaaaggggtgatgcactctcttgaggtgtcccccaacaccaacatctaagatctataaacaggattgttaacacatcttccttttttttgttttttcttttttccttgagacagggtctcactctatcacccaggctggggtacagtgaaatgatcatggctcactgcagcctcgaactcccgggttcaagtgatcctccctcagcctcccaagtaactgggagtagctgagaacacaagtgcacaccaccatgcctggaaattttttttgttttttatagagatggggttttgccatgtggtccaggctggcctcaaactcctggacttaagcctcccaagtgctggggttataggtgtcagccatcacacccagccaaaccgtctcctttctgtgtacatctgtcttaccaagtttaccatctgtcttaaatttctcctaaagaagataccttaccagagataattaggtgcagtggataagttcatgagctgcaggccagatggccttggattagaactcacgctttgtccccttctaggggtctgagcggctttggccaagtgaatagagccttgattttcttatctacaaaatgaagctgataataaaagtgcttacgtttaagagttactatgagtattaaacggggggtgggggcaggggcggcggcagaaatgcatggaaaatacttaacacaatacttggtgtatactggcttatacttatacatatcaagtaaatggtagatgataatgataaatatgttgcctattgggcaaaataatttttgtaataagtaatctattactgacttttgccaagtgttaagaatatataaaacactcacgtcttgtattttttgcaagtattcagaaataagtaaaatgtgctcatggttgatgagatggttgatgagacagtacaaagttaaaaagggttagatgccttcaaaagctgcccaaattctaaagacatttagtactgccctgccaccttctgatggactaatgcttttatgtgtaaaatgagtacctctggatccttgataggattcgcctgctacaaatgcacaccatgtttttatttatgttttgatagtttgttttgacccaaggcctgtgtcttgtcttgcttttcgatagtctcccttttgatatccatggctgccgctagtgctggtggccttggaaatccaccacattttctggcagagaacacaacacttgattccgtctggagctgctcaactttgggcctcattagcaggctgaggcttatatcagcacagcacatccctcccccaacatcgatgcagggactgatccagccctgtggcagcctgggagggagggaaaatgagctgggaagcaaccagacactgaagcttggctggcgttttgtggagcagagtgagcatacacagctatctgtccttcagtgccattactgatgttgccattattgttactataatggttgggactgttgttctgtgtcttaaggagaccacatactcaccactggctatgcaccaggagctattcaaaggacattacaaacctcacctcgtttatcttcacagcagtcctctacatgaggaaacttaagaaataaagtcacttgcccaatatcacacagctgtcaactccagagcacaagatccagccagagctgaaaccttatccacaccaccttagtatggtgctaagaggccacccacaactctcacctattcaagctcaggtgaatataagaagttggtgggaacatgatgtgacagtggtcagcaagaagccacgccacccagtatcaaatatgaccagaactcctgatgatggcttctggggaaactgactgtcaattaaaatggagaaaacacttgcactccagcctgggcaacagagcaaaactccatctcaaaaaaaaaaaaaaaaaaaagaaaaaagaaaaaatggggaaaacacaatgacccaataatagcaaaacaaaaacctttcctttcaagctatatgaaaggctgtgcccatcacgtatctcacatgtattaatggcttcaaggacaattccttttactgtctatttaaccaaacatttttgtgacttaatataccaaattataataaaacaaggcccactctattggtgtattcatgtagtacttttattatgcatgtaaaaaaagacagtagtctgaattgatgaggtacaaaagtcagagagcaattctgcaaagtaaaggcaatactggctggtcttaacttctctgcaacactgttactgcagacatggatgtctataacataggaatacgagaacgtggatttgagttcagtagtctagcattagattttgtggattgccattccagttcaactctttctacttagctgtgtaaaactggataagtcacttaacctccataaacctcagtttcttcatctgcaaaacagagtataacaataaatatctcatggtttattgggagaattcaaggatgcaatctatgtaaagactttgcacaatgtctggcaacatttcaagtgactgataaatgtaaactactgtgtgttttataccttaaattatctgatttggccccaaatcatttgtaagctatttcagcagtctcatcatctttctttaaaaaatgcaactgttgtctgaacacctgttaggtgataagaaatatactgaatgctttgtatgtgtattacttctaatccacccactaatcacataatttagaaattattgtcatcaattaattgttaaaaacaccagaattcaacagacagtaagacagcccatgctttttctatgacatctcccatcccaaccaagaagtggatatgaatgttatcttgctgcccagggcatcgagatcaggtactgaaggctgacaatccctaatcttgccatcttagcccagacaatgacactagaaattagctttggcatccaatgtggcatccagcccctgtgaagacagcactcttgtccaccacagatcttccatcatggccactgcagcagggaattgttccctttgtccatggtggctttgccacaaagggtccacttgtggtcttcagttaaatatttgctttaataaagtgacaaatgtttaaaacttcatcttttttgtagcctttgagttcaacttgcaaatcttatcattctacttataagctgaaaattataagtttaaaatgtaattcactttcaagggggcttttggacttaaataattcaagttagatacactaaactcccttaagtaatcagtatcatttacaaatttaatttaatttttaatttttcttaaacattttaaactgcatttacaaactcattatacccattttcttttcttaaagtacttcaatttctgacctggaaagcaaaatctactaagtattaaattgcaccagtaactccctaacaaattaaaataaaagattccatatactttaaaagcattgcaatattgtttataatctttgtcaaaaactttatctttcaacataaaaattacaagagtaatggtaactactcaactaaacatagaaagtagaatcaatatctactttgtcagttactttaatattccgagttatcttaaacagtagaaacacatcaactaaaaaatgtacgcagattactaataattgataagcattaattatcatgggtttcagaaattttatcatgtttactaaattctaaaccttccttgggttaaaagtaacataaccagtaactaaatacttttgaatcccatgtcatagacaaggtcacaactctaaggagctggggtagccctctcggtcggggtaggtgtgattttttgcatgctcttgatagccaggttggagctatctttaccagttgccaagacaaatgggaagccccatacagagtgatctcaaagatggcatcccggggttccctcaggatgtgctactacatgtttttaccaaattctgtctgattttggcagagagaagtcagctaccctctgtaaggctaaagctattacatttacttaaccatgtgaatgttgttttgttggagtgttgttgttgttgttaggaatttcagttgctttctaattgcctgagaaccttgatgtcatgcaatagaattctttacactcagctgtaattcttacaaacttctataaattgtgtcacttgatttagggagatttaaattcaaacccctcactgtaacctcaataaatttggtgctacactcctttatgaatttctttactgcctgactgaattcagaattattttcatttccttcttgtctagaaggggcaatattagttataattcggtttggctgttaagggaccaaaaaattaaaataatacgttgaaaactttacataagagagagaagtttctgtttctctcacatgaagtcccaaggtgagttatagggctggagttgcaatttcataatgatcacagttcgtcaacatatggcttccacttcatggtcatactggctaccagtagccataataaaatcacacgcccacaactagttacaagggaggttgggaaataatttattccaggtagccatatattcagtgaaaaagtgacaggtcccctagtacgtgaggacaagtgctgaggggtagaagaagtgttgtgaagatactggcagcatgcatactggagatcaagtacccaggcactgagggatgttggggagcttcctcacaaagacacggtagtagcatatctgacagcaccccaaaactgaagatgttggagagcacgggggttgtgggcagaagagacagaacagctgggaaactgatcacactgattaataacagtaaattaaggaaataatatatagaggatgagagcaagtttcttgctgttggaggaacttccaaatatggaaaggtaggaggctagaaagaaccctgagatttaggaatgaaattggaagtatcaatataaacccaatatttttggtaacacaggtagacaaataaatggttgcagatgcatgtttatgtatgtaaatgtacatagggagggtaaaatgaatgtgtatattttatactcatatatatttgtgtgtatacttacatatacatatatgtgtgtttgtgtatgtctatacacacatactacctcctgagatggcctaaaagcagtaatgcctcaacagtaatgatcacaaacaagtgcccagatcttagtttctaaatacaatctttcccaaaaacaaccagggtttcttagagaaatggctgataccagggctgggacaaaaaagggataagttgacattgagatatcttgtgccataaagtaaggaagtggttaaagaaatgatgaagccatgtcaaaaaggcttagaaatgaaagacaatccactgaataaaacaagaattcgtaagtctttgatgatataaataaggtagaagaacaggctcttccttatactaaaataccaaccagcaaatgatggaaatgagaataccaattgacaaccccatgaaagccaagactggtgggtggaaggtagacaaggaccatgatattggcataatctcagaacatctccccacaaaattcaaatcacttacaaaggaaaaatgtcaaatctaaggtggagaaacctggcatgtaccaatgtgaacagagtgggacaggccatgtgccttctgatgggacatatataaacacttgactatcatttctatggcattttccccgagtgggggacctgattctggccatgtggagacactggatggatccaggttgagagacgttctaaacagaaaaagacctgacttttttttaaaactatcaaagactagaaagacagggaaagatcaaagaaatgttccagagtagaagagatccaatagacatgataactaaatgtgacatgtgttcctgactgaaatcctgggtcagaaaagaaggacaatcgccactgggatagctggtgacctttcagtgggctttgtgtcctggggggcagcagtgcatcaacactgtttcctgacttggagggctgaatgctgatggtgtaggagagtgttttcactatttaggaaatacatacccacaatgtttagcagaaatgcagtatcacgtttgtagcttcctctcaaatgctaacggttgaggaatcaggatgaaaatgatatgggagatgtctatattgtacttggaatttttccctaagcttgaatttatttcaaaatagagaattaaatttttaaaatatcaaggctctattattcaggaagagcgggagccctgagagacagctagtggtgtctgctggtcaagccacaaaacatcctactgtatctgcatatatttcttggctttgttcagctctaaagtcacagaccttcttcccattgtctctgctgcagttttttgctataacaccattatctccttcccactagcccatcaatgagatcccaacctgctttatgtacaaaccagtaagagttaccaaggacaacatgttttggggccggataacaagatgtttttaacatcacagtttctgcgctgcatttaagagctgttggacacaattctgccctgaggcagaaattgagcaggaatagaagaatggaaataacacaagtaaaaaaactggagaacaggcaacatggggagtatgagataacataaatcgtaaagtagaaaacagaaatgagagcaggtttcagagacataggcttggactgcctttctaccatgcacaagaccacctgtcgctagcatgatgactagtgtttattccaaaagtctggtcaatgaatctcccaactagaattctagacatgtttcttttaagtataacttaatgtttgcagacttctccctcactggaagaggaataaaggataggaagaatctccttcctagtatcaaatgcatgcaactctacctctacaatactcaggtgacattttaagaaatactaatatcacatattacatagacgtaacatggctcttagcatcaatttgagatgaacagagatcgttctgatgtttctaatgaagagaataacctttttgctccttttcatattcaaatttatattccataaacatttattgaattcctaccacgtcctgaccaccaaggtgaataaaacagccagtgccctcactgagcccaaggagacagacccataaactaacaaatttcataaaaagcacagatgacatcaaattatttgttcactatttctgggcttaccaaatgaagttgcagacctcatgtttttatttgaacttactttattctgttataaggttaggaaccacattagggaaactgaacacaaactagctgtagtctttatcatttaaatatatagagctgtatgatatatcactgaaatcagtggtttccatggtccatggctgagcggcatcagaatcacttgtagtgcatcttaataattgagaaatccaaagcaaatgaatcaaaatcccaggaattagattcagagttcagtgtttctaagagttccacagagggttttgatgcacaggcaagtttgggcacccctgaaaaatcactgtcactgattctaccaagagtgaccttaggcttgcagaacactagtttgcaaaataacaatcagtcccttggctgtgaaattcacaagactgctgattaattcatttgaatatgattaaactgcttccctctaccctgggtttgtgaatggtgaggaactgaaacgtttgctgcaccatccattattaatgctcttcccttccaaagcctgtccctttgacctctgtttattccggcttgtctcctatatgagtttatagttacttattattatgtgcaattacatcatgctgagtgtgaggacaccccacaagctgttagctatattaacttaataatagatttcagggtgtgatttccaattaatttcattttccatatgcacatgcagctccatggaaagccaaaattatagagtagccatatggtgcctcataagaaacaattaaaactaattttctattctttgacaccaaaaaaaaaaaaaaaaatacggtttacatgccacagagaaaattgaaatttgaacagcctcggtagctctctagaaagaagatgccccactttccacatttgtggcatggatattccagtttcttgcttggccgtggtggactatggtcccacctggcttgtagtacatttgattcctcactgttcttaccctgctggactgtcttagagcagctgtgagaaagtgctgggctttctgtttcacaagagtgagttgagttgaaaagaatagtttgtctccttcagaaacagatgatttccggtaatagaaatttcctactgatccgtttccaaaaggcagtatctgaaacactggggcaatctgcccaagccaaggagaaaaataagcagttccactaaaagcagatgatgattgttaagcaataatgtaactgtccaaggctgaggagggctggagaaagggtcgctcccctggaaactcaggctggtttgttaaccagatcaatgatccttttacccttaccatatggtataattttgttaattcccaagggccctattttattaaaatcatcagctgggaggttaaaaaataaaaaatgaaacatatcaagaccctattcaagataagcagtgtgacaaaaaataaaaatccttgattttattagtctttcatataggtttcaactcttaaaactatcaagtttttatgtgggagcaaataatatcacaatgtattaatagatttactctaaagaataccttaactacgttgctgaaaacatgactaaatctcattattttttattttatgacaaatcccttctacagctaacatacgtgcacaagggtggcagaaggaaccatgagaaggtagagtaagaggtcagaggtctttttcgattgtagtatgaacgagtaagaaaactacctgtattagtctgttttcacaatgctataaatatactacctgagactgggtaatttataaaggaaagaggtttaactgactcactgttccgcatggctggggaggtctcaggaaacttacaatcatggcagaaggtgaaggagaagcaaataccttcttcacaaggtagcaggagagagagatagcacaaggaagtgccacactttaaaaccatcagatcttgtgagaactcactcaccatcatgagaacagcataggggaaaccaccgccatgatccaatcacctcccaccaaattcctccctccatacagggaggggactccaattcggatttcaatgcaagatgaaatattggtgaggacagagccagactaccatctatatgtttactgtaaagaaaaaaataaaattatcagaggtgaaactttgtgaaactgacatcaaaatttttaccaataaaaattataatggcagagaatttttcacagagaattttcagggcaataaaactactctgtataatgctataaggacaaatatatataattagacatttgtccaaacccatagaatgtacaacaccaagagtaaaccctaatgtaaattatgaacttggcctgatgatgtgtcaatgtaggttcatcaatcgtaatgaatgtaccatgctggtgggggatgttggtattgggggaggctgtgcagttgtcgggggaggggtatatgggaactctgtaccttcctctcaattttgttatgaacctaaaacttctctaaaaaattaaatctttaaaatatatctatataatggctacaaggaagaaaaactctaagtccatgttaggagttgaactgtgtctcaggacctctgaaaattcagttgttgaagtcctaatccccagaaactgagaatgtgatcttatttggagattgagttgttgaagatgcagttagctaaaatggcatcattagggtaggccataatccaatacaatagtatcttttaaaaaatgagaaatttgggagactctgcttcacagcctcagaagggccaaccctgccaccaccttgagcagggacttctaacctccagaaccatgaaacaatcaatttctgttgttcaggtcacccagtttgtgctactttgctatggcagccctaggaaataaatatagccatgttaggtaaagaacgtgagatctgggttcaagccctgagtctgccaaccactagctatgcaagagatgtctctaagctagatgtcctctctcaaccaggaaggtaagtaaagcctcctcacagcattgtggtgggggttcaattattaatacacaaagccggtgaggtacaatgtacaagtcttggtgtctaggtaagtgtaggatacctaaatggttctcttcactatgcccccaaccccaggagtaaactcagcctttgggagtgtgggagaacctcatctgcttttctagtgcctcctccaagtaactccttcacacacagaacatcacaccaggtcttccttttcatatccctggaaccacaaactctccccctccttcaggttaggaaacagcaagacgtggaagtttctgcctagccttgagatgccttaggtgtcagtgatcaattaaaacagataagctcccctcccaactccatttttttccttccctcctcacccacactcacaaaatgaatataaaaccagcataacaaacacaaactcagcaagttaatactaacgcaattgtgtactttgctcatctagaatgctaggcttctgactccacaagatgctaaaagaacacaaaaaaatcctctttgatggctaacattttcttccttaaggtaagaacaacacaatcctctcagtcatttagtattatattagctttatcttattcccaggggctgcttgcaccttgttttagtgactcctacaaactgcactggtcagaactactgtagcaagcactgtgcctattatctttttgtagtaaagggttaatgaacattaaataccacatttatttactctcatgctggtggacacagatgagcaccaagaaaatgaagtgggtctttaacatcttttgctttcttgcattaaaaacactgccaacattaagacatccttacatgtggcatttcctgctcagcaagtcttaaagttcccaacaactatttaaaaaatatcctcttgtgtggcaaaataataacaaaaagcttagcaacagcagccccctacttgctttgctaaataaccgttccaacaaaaaatgagctggaagattaagtgtatcttcatattccagcaaaaataaatatttagaaaaatatgttaggccaaacaagtcccccttcaacattcaatcaaccattccctcttggtttgtctttctttttgcccccctactctattcccatcccttccataaaaatgactaaagaaattcttgcagtttcacttttcagtggtgcataatcaaaattcaaaggaaattaaatagctgtcattatcatgagtatcctaggattctttattcctgtacataccagttcaaaaggcagacaaatgcacacatgacacacacttacatgcagagttcttacaaataaatcttgtgtattgctagtttgctattacactgtagggttttaaaagctcaatacatcatttgaaaaggttcctcctctacttatcagtcacttatccatgaagcctttggtttccagcaaggttttggcccctcttcctacacccctgcccctactcccttctgcatttttgatgggggaaatgggaacaggtcagtgagaggatgaacgactactgtaaatacttaaagacatcaattgaccattcatccccccttcccttagggtagagtccagtagagcacaaacattctcactgtaaactcttccttgtgtaatcttcagtcatagtggcattccttcatgtttgcactttaaatataccctaaaagcccaagttctccaattcagtttttttgtttgtttttttttttgagacagagtcttgctctgtcaccaaggctggagtgcagcagtgccatctcggctcattgcaacctccacttcccaggttcaagtgattctcctgcctcagcttcccaagtagctgggattacaggcacaggccaccatgcccagctaaattttgtatttttagtagagacagggtttcgccatgttggccaggctggtctcgaactcctggcctcaaatgatccacctgccgcagcctcccaaagtgctgggatcacaggcgtgagccactgcgcccggcctccaatttagattttatttggcaaaacattcccccaattttatgtaataaagatgcagcacgatggttaatggtcaagtgtatggcaagttgcatacactttttcaacactaatttccttgtctgtaagaagacaaccactctggtcacctcataatgacactgaagaatttaaatgacttgatttttataaattgcctcaatacaacatctggcacatagttaaatgctcagtaggtggtagtccctactattactgctattagtattatccttattaaggctaaaaagtcttgcaaaccttagtgaactgtgtatgtatgtacacatataaaaaattatctatatcttttaataccgtaatttctaaaatggaaaactatataatttacacatttttcattttaatgattaaattaataaagtaattatatgtttgatatagcttaggaattataatgtgtacgatttacattctatttattattttaattatttctattatagtttatttataattttaatatataatacatatatacataatatataatacatacattttttaatgtattctctgaaaatgtcccaataccacagaatctgactggaaaataccttgggtactcccaaaaccagagccagaaatcgctatattagaaaattagttttgggattctaactgctgtgaacagtgaaaaacagtatggtctcttaaggagttccaagcctcttgttctgactttgaacaaggcccgtcatgtgtaaaatgctctattgttcctcattccctaagtttcaagtcctcaactagctcagaataacacatttagcctttaacaggaatagtgagaaaaatgagacagtgaggatgtgtaagtaaatatgatacgtccataaactagaacaccatgaagcgtttgaaaagaatgaagctgttccctatacactgacctctaaaatattgttcagtgaaaaaatggcaaagtacagaacacaatgtacaatatgctcccttttaggctgaatggggctcacttaacttcttaaggagcctgcaactgaactttagcatatgctagaaaagaagtactactagttggccgggcgcggtggctcatgtctgtaatcccagcactttgggaggccaaggcgggcagatcacaaggtcaggagatcgagaccatcctggttaacacggtgaaaccccgtctttactaaaaatacaaaaaaaattagctgggagtgatggcaggtgcccgtagtcccagctactcaggaggctgaggcaggagaatggcgtgaacccgagaggcgagcttgcagtgagcggagatctcgctgctgcactccagcctggacaacagagtgagactctgtctcaaaaaaaaaaaaaaaaaaagaaaaaagaaaaagaaaagaagtactagttgtccctgaagctctcttttgccaattaagtgatatctgtgaaagaatagagggagagggataaaaagagaaaaacattaagaatattataatttttcctactagaaaaatcaagtgtatctgcaacagcaatgtaatttgaccaatcgaacatactctttccttctgtaaacagagcggctgccagcacaggaagtaatagtgtccattttttggactgcattccacttggaagattatctccaaagtactggattccagcatatacactttgttgagctgatctacagggctcactagctttcccccctcccctcgctattaatagtactcactctgatctttacctcacactttaccttgacttagactttcagcaacctgcaaagtaatctaccaaaacagagaaggaaatatgtcagcatggcaaactgtattagtgaaactagttagaaacaaaacgccacaggtataaactctacattcaccaaaatggacatgagttactaaataaaatcctctcctgcaggtactatgcatccctgtcttaatcatctgtgtttcagattctatacaaaacagttagcaagcttgtccaatctgtggcccacaggccacatgcagctcaggacagctttaaatgtggcccaatacaaatttgaaaactttcttaaaacattatgagatttttttgcacttttttctttttagttcatgagctatctattgttagtgtgttttatatgtggcccaagacaattcttcttccactatggcccaaggaagccaaaagactggacacccctgagtcagagcttgaaatccaggtactgcagtggaaaggtatcatatttttaaaataattaaaataagcctttcgtgctatttataatcttagaacaatatttttcctttctggtgaaaataaaatgtaccttgtattctaacacaacttctattcttcccactgcttttttttttttaacaaccaagcatacattaagttttcaaactgtagcatttgaaattaaagtaatgagtgagtgactctggtacctaacagactcaatcaagtcttaacttaaatagtattttgacagggaaacacattaaatatgtgctacgtgctggtcactgcactaggtgctgagtataaggaagcaaataaaacaggttccttgatttcactaggattatgtctaggggagaaaggtcattccacacaaataatttcataaactatttgatttagtcacatatactctatatagttcctgatttatatagagttagtaataaaaactctactaaatacaatatagtcttcttttaaatcaatgtactgtagcactacagggtgccttggaaatatctatgtgaaaagtagttattttattatttcagtcttaccccaactgtataacccaatattagctattaaaatacaaatatgccatacttttaaaaaattaaaaactaacctatttcattggccactggcttaagtacaaactgtgtaacattggcatataaacaaatacccttcattgccaacagcatgagatatgccactgcccctgagaagcatttctgactctctagctaaagtttgtaaactctctggttgccacaataatttatccaaatttccactgtgatgtttatcatattgtacaagagtaatttgtcatcctccataacctgtgagctcctcaggtgcaggaacaatgtctcattcacaacgtatccctagcactctcactagcgcctagcaccttggagcctctccacaatggtctactaaatgcattggtgaaaaagggtgaattgaacactacacggcagctgtcacttaaagtacattttgagcttccacaaggcagattcactgctcaaattggaaatgttctaaaagtcttgttcatcttagctgtctatcctatctgaaaatcattccttccttttgttatatttgatttactgaggcacactctgttccagggaccacagtaacaaccttgactcaatcaggcaaggagagtatagcggtggaaggattcacacacctgtccacttaagacaagattttgcattcaacgacaagcacttgagtgagctactcaagcatcaggcagctgatgagcctttctgtgatcttactgattttccgaatacggtgaacattctagtctgtctttgacctcacaaagttatatttttacttctcaggttgcaaatttgcagtggtaaaatcatcctaaaaactttacaggaagaaaatggttaagtacgttttaattcatcaaatgagagactttagtataatcattagaattacatttgggggggatattttaaaatatggaaaaaatctcatataccatgttaatgttaaaaaaagctgaatacaactgtataaagtataatcaaaattttgtgaaataaatctatatgaaaatagtcacatatacatatgtatctccacacagaaaaataacttaaaggagtttcaactttttcaactatgatcatgtattatttataaaaattctgaaaataatgcatgcttttcttctaaagtaaaaaacataatttcttaaccggctttatggtggattttgcaaagtaacaattcctctactatcttccaatgattcacttttcttacaattttaaattatatcttattcatgaaaaacgcatataccagaagtaaagatgaaccactatgtttctctctgtggtgaataaattacacttttaagaaatttaaaagatacaattacctaggacattaaagattaatagtttcctttataattatagattccttccatcctatgtttttatgcctcataattgcagtatgtctaacctcctttaaaaggcaagaaagactgggcatggtggcacacgcctgtaatcccagcactttgggaggccaaggcaggtgcatcacttgagctcaggaattcaagactagcctggcaacatggcaaaacccatccctaccaaaacacaaaaaaattagctgcccatggtggtgtgtgcctgtggtcccagctactcggaaggctaagctgggaggattgcttgagcctgggaggcagaagttgtagtgcgccaagatcgcgccactgcactcaacctgggtgacagagtaagagcctgtctcaaaagaaaaaaaaaaggtgggaggaggaaaaatatcaatggaaacttaaaaatacttttaaatataaagtaatgctgcattttaatatggcagaactatacttcctatatcaggattttttttttttttaagtgacagggtatggctctgtcacccaggatagagtacagtgatgtaatcatggctcactgcagcctcaaactcctggactcaatcagtcctcctgtctcagcctccctagtagctggggctacaggtgcacaccaccacacctggctagtttttttcgttttaacgttttgtccaggctggtctcaaactcctggcctcaagcgatcctgccacctcagtttcccaaagtgctgggattataggcataagctaccttgcccagcctcctatgtcaggaatttaaagactaaaggaaaatggtaatctgaaaacttttttggcaaccactatattcaagtccttctttattcccacttatacagaaaaacttcatttccttttgttcttttttcacattcgaagaccctaaaattgatttttccccagttgagccaaagtggaagagggacaatgttttattaaaagattcatttcccagcataaactgtcttctttatttatatacaaagaaaatctgtctttttattcttgtgaaaatgttttctgaagctatcattttacaaagttaattcaattgtacttgactctaaaaacagacagagagggagaaaagatgatgatgacaacgctgttagccgcctcagcaaaagaaaaagatacgcactgatcagctctcttaagaatggctgcacaaattaaattccaccaaaatgtaagaacaagggcatcgtggtgaccagtcttcagtgacttctgttgtgtgtgtgagagagaccaggacagcaaaagaactgtggtattagagtcactgaactggttacaatttaagaaacattcatcgttgggcttaaatgtactgaagaaaagggtattcatgtgacacaaaagacaagagaataaggagaatccaaaatgatccatcaaatgaaacagactgaggggcatggttttgggccaagtggagacacccagctggctacaacactgaagggaaagcatcgaatagattttaaagtagcaaagtaaggaagggataaaaataaataaaagactaaaaagtaatatgattctttgatcctatgtaagtctgagattccacagcaacacagaaagagataaatgagagagaaaacgtgagaaaatgaatgttttccatcctggtcttaaagaaaacttaagtggcatctttttaaaagaaagcataagtattttctgaacacaaacttcaaatcattaaaattaccttccctcattcttcctagagcagcaagcttttaaaaaataaagagtgagccgggcgcggtggctcacgcctgtaatcccagcactttgggaggccgaggcgggcggatcacgaggtcaggagatcgagaccatcctggctaacacggtgaagccccatctctactaaaaatacaaaaaattagccgggcgtggtagcgggcgcctgtagtcccagctactggggaggctgaggcaggagaatggcgtgaacccgggaggcggagcttgcagtgagccgagatcgcgccactgcactccagcctgggcgacagagcgagactccgtctcaaaaaaaataaaataaaataaaataaagagtgaaagctctaagaacaaatttagagctatatggagtttccactttttcagttttcaattcctaagtcagagttaagattgttatagttgaaactgtattagaaacatatttaggaacgatgattgtaccgttgagcttttcagttatgatccccacccctatcctaactggaatcctgaaattatcaagcttaccaaagctaatgcattaattctctcatttcatgattcattaactcagtaatttcctgcaagatacatggccaacaaaaatctcaaaatatccctgaggatattccagattaaaaatgctaaattcttaggacataatctttctagcactcatagagtttactatttcttagtttgttacaactatttgcccagatgcctgtctccccaagtagactgtaacctccaagcaaatgaagattgatcaagtaggattcaatatttctttttcttatacacagatctgatcatatttactctcacctggactcttaggggcggggctatcactcagagccaccggggcatggctgctgcccaagtggacccagaaggctggactttggcctcagtgggcccagaggcagagcatcatggaaacaaagagaattattctcaagccttaaaatacaatggactttgtcctgctaggttttggacttgcttgggccccaggattcctttcttccttctaatttgtccctttaggactagaatgtttattgtatgcctgttcgcctatttgggaagcagataacttgtctggtttcacaaattcacagcttgagaagaattctgcttcaagatgtatcacacctagagtctcatccatggctgatttagatgagattttcaacttagagctgatgctagatgggttaagattttgggggctgttgggatagggtgaatgtattttacatgcaagaggaaacaaatcagggatgggagggggcatgcagaaggcagaatgctatgggctgtttgtaaacctccctaaattcacgtattgaattctcaacccccagtacctcagagtgtaaccatatttagagacagggtctttaaagaggagattaatttaaaataaagccattaggaagggacctaatccaatacgatgatgatgtccttataagaagtgggagagacatcagggacaggagtgcccagaagaaaggccgtaagaggacacagcaaggaggtaatcatctgcaagtcaagaagaaaggcctcagaatggaatcaataccttgatcttggacttctagctttcagaactatgaaaaataaacttctgttatttaaaccacccagtgggtagcattttgttatggcagccctagctgactaatatgcctgccatttacattctccctgaattgccagtcctgtggcaacgtaccacactacttcatctacaaatgcacatttgttccttttgtcagggactgtgtagtagaaaatctggccttgcccaaagggtggtctggcttttgtcctcaacttctaggaggcaacccatgtcatccctatgggaatatgttagtcttgggaaagaacaattaaggtggggccagctacagccaatagtcttaggttaggggctgggcatgacagaaagatcaatcatgtgttttacagtggggaacacagaggctgaaatcaaccacatgggcaatcaggcaattgatcatgcctatatagtgaagctctcaataaaaactctggacactgaggctcgggtgagcttccctggctggcaatactctgtacatacagttacacattaacgacaggagggtaatgcatcctgactccatatggagaggacacagaaacctggtgtacagaatcctcctaaactccaacttagttgtctcctctttctttgactgatctgatttcatatcttttccctgtaatgtaatagtaatcatgagcactcagtgagttttgtgggtccttttagcaaactgttgaaactgagggtgttttggggaaacctcacacttgcagtcagtgtgaaaagtaaagacagtcttggagactgggccctctaattttgcagtttggataattccatgtagggatgaaacctcagatgtcactatctcagcaacatttcttgtatctaccctaaacagagttaatcataatttccttccttctcagtataccacaggatgtaatcctaatttacctggtaattacagtgattctaaacctgaggaaattttgccccccacagaagagaacatttggcaatgtctggacacagttctggtggttacaactgggggatgctactggcacctagtactccacctccaccctaggggatggaggccagggatgctgctaaccatcctacaatgcacaggacagccctcacagcaaagaattatctgacctaaaatgtctacatcatcaggtttaagaaaccctgcattagactgttgacatttaccggatgaaccccaggtctgagacaacaactcttggagtagtgagacaatagcaccctgaattctaagggccagtgtccaaatgccaattccacataaaacacttctgtttaatgtcaggcaaatatccaaacccttggccctcaactatctcatttgtaaatgaaactaaaatagcatgtattccacagaattatttacagaagaaataagaccatatattagaacaagttagcaaactatttagaccacagtaaacactggctaaatgttcaccctatatcatttaattttccttgtacaatgtaaaacattttataaaaaatatttgcactgactagattactggtaaaaggtcacaaatcactttttctttggtttagaacagatgtaggactcctggatctcataaatgtgggctactaacaaattaaatgtttctttctatgcaaaatttgtcttctcttaccaagaccacatgttgctctttccttccattatcaccacttatgggtggcttccttgtgtgtccattttcttcagagaaacaaagtttatatcacatatgagagttaccataagaggcaatgacaaaggaaacaatcaagcaatccagaaaggagattgtagtccacctaatacaaccacctgtgaaatgcaactgccaggtaggcagctccttcctttatgatcatcttccaggaaattacaaattgccccacatcagacattattcaggtcaaatgcctatctatgcatattatatctgagaactaaaaaggtttaatttattccctttgtgtctgtgtctcctacaatcctacatctaaagtgaattccccaagaaacaggagtaacttttccctcagatccccaacctatcacaacacctagcacactgtatatgttaattcatcattcttggataaatgtaagaaaagagatacagatggccaaatggatgaaaaaatacaagaccaagtggaggaacaaatacaagaaggaataaatgaataattaaatagttctttagcctataaatagcagtactactaatttctgcttgagcttcaacaacattaaaatatcagtgttcttacaaacatatatgcaggacacaattgttcaacaaaagaacttggcttgcagctataccctgcacagtaaaaaaatgtactctctcagtgttaatgaatgatttaacccagagcagtaagaacaggttagattcttactagcaggaagctactctgcattttgcaacaccacaccacagactacaggttaaaacagccaggaatatgacaaatatcatacttactgggagagaattaatgctactcccctaagatagaaggcaaggtaaggaagtcgcctcttaccgattctactcaacatggtagtagaggttgagccactgcaagcaggcaaggaaggaaaaaaaaaggcattcacactggaaaaaaacaaaaagacataacatggcctattcacagaagacatagttctgtatagagaaaatgttaaggaatcaattttaaacacaatttgcatgaataaacaagaaaaggaaggtcacaggatacaaaataaaagatacaaagatcaattgtatttcaacatacaagcaatgaataatctaaaaatgaaattattaaagtaatgccattcacagtagcatcaaaaataaaatacttagaaataaatttaacaaaagaaatgaaagacatacgcttgaaaaccacaaaatattgctgaaataaagatctaaataaatggagagctattccatgttcacagactggaagattcaatattgtgaagatggccatactcccacaattgatgtacaggatcaacatgaactctaatcaaaacaccagcaggtttactttcagaaattgacaagcagatcctaaaatgtatacagaaatgcaaaacacctagaattgccaaaacgaatttgaaaaggaaaagaatattgaaaaattttcactttcaaatttcaaactttctaataaagttaacagtaatcacgtcaccatgtttctgacatatattacatttgattgcttccattagaaattaccacaaatttagtagcttaacacaatgtattatcttacaattctgtaggtcagaaactcaacactggtctcaccaggctaaaatcaaggtattagtgagacagccacatgggagggggtccctggagaaactccacccagtctgcccactggggtacagcctcgagaagttcaggatctttccagcagaaagcagcctggcccctccttttcctgtgtgaaacctgggattcaaacggcctggtgggaagcgctctatcagggacttggcctggtgagaatccttgtttccccctttttttttctttttcacccaataaaaccctgtcttactcaccattcaaattgtctgcgagcctgaatttttgtggctgtgggacaaagagccccatctttagctgaactaaggaaaagtcctgcaacaacagcagggctacattttttcctggaggcactatgtagcatctgtgtcattgctcattcaggtgattaacagaattcagttcctgggcttgtagtactaagatccctgtttccttgctgacagttctcagctactggaggacacatacattccttggctagtggcccccttccaccattttcaaagccagtaaccacaggtcaagcccctgtcatgctcaaatacctcctcctcctttcatctctcatctctgacctaaaatggaaaggttttctgcctttaaggacttgtgattagattgggtccccctagtaatccaggataatctctcatctaaacgtttatacttgttaagacatctacaaagtcccttctgccacataaataacatattcacaggttccagggcttacgacatggacgtctttggggaactacttttctaatgaccacatggtataaagatagatacataaatcaatggaacagaatcgagaggccagaaataaattcttacatttatagtcaattgatttttggcaaaggtgccaaggcaattattggggaatgtatcctctgttcaaaaaatggtagagacaatagcacaattttaacttagactctcaccgcataccatgcacaaaaatgactccaaatagattcacagacttaaatgtaaaagctaaaataataaacttttacaagaacatacagtagaaaaatcttcgagatgtgactcaggtaaaaaaaaatttagatacaacatcaaaagcattctccaaaacagaaaaaaattagtaagttggactttgttaaaattcaacttatagacttcaaatggcactactagaaacatgaaatgacaagcaacacactgggaaaaagtatttgcaaaatacatatctaataaaggacttttctccagaatttatgaataactcctacaattcaataagacaaacctcaatcaaaaaatgggcaaactatatggccagataatttaccaaagaatttagatgaatggtcagtaagttcatgaaaagatattcaactgcattagtcagttagaaaagataaattaaaaccacagtgaaatatcactctctacctactacagtagttaaaattaaagagacagaaaacaacaaaagttagtgaggatataaagaaatagaaactttcatgcattgataaggggactgtaaaatggtgtagctactttggaaaaagtttggcagtttctcaaaaagttaaccatagagctaatatcatccaataattccaatcctaggtatctattcaagagaaatgaaaacatttgttcacaaagacttacatgaatattcacagcagtattattaataatagcctcaaagtgcaaacaatctaaatgtccaccaactggtgaacagattatccacataataaaatactattcagcattacaaaagaaataactcttgatatatgccaagtcatagaagaacctcaaaaacagtatgctatgaagccagatacaaagagccacatatcatatgattccatttatatgcaatgtccagaaaaggcaaacttagagactgaaagtgaatgaggggttgcctggggctgggggtgagaatggcaattaacatcaaacaggcattagggatcttatgggagggtgaaaatgttccaaaagtaatttatggtgatggttgtggaactcaatgaagttactaaaaatcactgaattatacacttgaaatgggtaaattaatgatacataaactgcatttctataaagttgttttaagaataacttattaaaaaagaaagctagccaacaaggacacctatgagaattatcctggtaggaagcatgtgttcttgggaaattattacaattatgctattgctactgaacctaagaataaaaaaagtccatctcatttagacagatttgaagaaaatgggtgatataacatgaatctagtggaattctagtggattctaggggcagctgttctctggattcctaaaggactgaaacagagaaactaggcacttatcatcaggccattcttgtcacgtgaaatataggtacctccatgcaggggccttgactgggaatcctctttcactgacagctgagtcctttttatcttgaatttccatgtaactgcagctgaatgaatatattggaaaagatgggtctccttgctatttccacagcagagtttctgtggacatgactattgccatgagaataataactaagaaatactccaatcaacagagtagcaaacagataacacaggtcaacacagttctcaagaaatcccagatcaagacttgtctgaaagacaggctcattgagtttgcagggatattgttcctttataacctagcgactctctgaagagagagacacagtatgccatggtaggatttgtataaagcaaatcacagaagtatttcatgtgggccagtaaacaattggtccaagttttaacaggaaaaaaaaaaggtagacttaggaaattttcttgattcagaattgaacagagttttcagaagtatttcccattcacaagtgtgttgaaacattctcctctttaaatagaaaatagatgaattgagataaatatatttaaatttccagagcaatcttgaagagctgcaacagtttagggaaatgtcaagaacaccctccgcttgagacaactgctctgctatgtaagatggagatcatcttaaggaaatagaaaccttctcgaagaaacttactgagtgccacatttttcccaactgttgatttttgtgaatttcagttgagagttactctcactctgccaactaaataaaaatatctcaaactgggttggaggcgaaaagcatgtaagttgagaagacagaaaatactacaggttcacctgattcagagcttgaacacttctaatcctcactaagaattgataaccaaatgcttcaaataaacttcacttgtcaatatcagtcatttaatttttattttatttttttttacaaaaagcccaaaatggattaaccacctgagtttaaagaactctactgattgatcgacccaggtagatggtctaaggaaagaattaagtccaactaggacactcaaaagtgaagtgctggccaggtgcagtggctcacacctgtaatcccagcattttgggaggctgaggtgagcagatcactggccaacatggcaaaatctcatctctactaaaaagtacaaaaaaattagacaagcatggtggcacatgccagtactcccagtcgggaggctgaggcaggagaaaagcttgaacccaggagttggaggttgcagtgagctgagatcctgccactgcacttcagccttggtgacagagacagactgtctcaaaaaacaaaaaaaaaagttaagtgcttatactgaagttacaaataagataaaaggacttttaaggaatattctctactacaaaataattaggactcagagcagagcttggttcataagtttaagtagaatcatgagctagagagaaaaaaaacgaattgcactaagtaaaagaagacatacatggaaatgacacaggaggagagctgatgtaaacattaaattttcacagctactaaatgctaaataaaagacttttcatattatagagttcttaaaatctggtggcatttcaacctgtggagacctaacacattttgctcagggcaaaaatctggcagccaaaagaatctctaccagagcctctgtcttccctggatccttttcctcaaataagggcaggaatggcaagaaagaaggcaaggaactcttcagagcctcagaaagtggtatgcagccaggtacacccctactgtaaaggggcatccacactaccagccatcatgctacatattttatatgcactttctcattcaattttactgaacaatggaattatagttccatttgcccaaagacctaaaggccaagatcaggaaggataccctctcaagatcttaagagcaataggaagaagagaaggtgtcaaatctgaatttcaaaaagcatcatcagttgcagagtgcttggtgagagcaggtgaagtaaggggggaagaccaggggtttattttgtatcttcctttctttctgggcttttatctctgatttggtcaacatttttaactcctaacacttcaaaatcacatctacttttggttaagatgattgatttataagttacacaatgaataaatagcataaactcaataatataaggaacacagagtaatatgtattatatattttatatatatttcatatataaaaaattttacatatatcatatataaaaaaattttatatatataaaattttatatatataaaatcatatatatacatatatatgattttaaagcctattctatatccaagaggtaaagaaatagtggcaactaatcaagagtaagctggtgcctgctggaactaattttccaataagtacttagacaaaataattatgagaatttatgttttcaaaatgtcttagattgacttacctagaaagcaaaagcatgtgaaaaatgtgtatgccaaatcttatgtgagagtagaatctcagggaagccagaaagagaggggacagggcaatgaggccagggaggaaggaaaggaatgcaaaatgggatgttgcctaggtgaccacggctgaaccggagatcacagctttccggaagcttggttatgggagatgggtgtctctagagaggccatacgaaccactgtgtctgggaatcatccctgaaggaagaagggtggagatgaggaagaaagacaaggcaaggaatttatctgcaggctttttctgactcccttctctcactggtcaaagtcagtcaaacattagcgggaacagcctgagacccagagggtctgatgggactgaacctgggcctcagaggagaaaaagggttcccaggcaggagagcaacacggagaggccaagggaggttggggtgacctggcaccagtgttgccgctctctaagaagatccaggaacacctggcctggcatcaattggaacacatacagaatattttctaggattttttactgttttccaaaggctaaaatttctatcttgcaaccctaaaatttcctcagaaagaaaggaattaggaatttcagtatgttatgtgcaatatcagaatttataattaaaataaagctgaaaataaaattatttcacccttaaataaaaattttccttcctcattaatagatcattttacaattgagtttccagtaagttaaagggctcatattcacaatttataaatcatggcaagataaggcaattacaagattaagagtagaagaatttagaatgtcaagtggcattaatttaagtagaaataagttctctacacataatttaattaatgccaagtgctcatagagctttgtttttctgagatgaaactcgaagttggatgagactaacacagtaatcataggctaacaccctgcccttcagaactacaagttttattgcccatcattttttaaaaatcttattactcagactacgtgcaatataaaatcaggggtaaaattcgaacagatgttaataagcttactgccactaaattacaaaccaagaaacttgcagaggggtctctctgtcctggcttctctttctacctgattggaaagtctgttctaggagcacagtgatattccaagctgggcactaacgtccttcagtgtagcacctaaaagctttcaaacaaatcagggtggtgttagaaaaaatcaaattttttaaacttgaacagggtaatggaaaataaagtccacgtcagatatcaaagatactacgatgttatcctttgaaataaagttagtatgtttaaaaaaattaacttaccttgtttataggaaaacacatgacattgagttacaaggtaaaatggtacctattattctgagatacataaacagaaagacacattattaaatatttaagtcacagatgtcagtcagtacaactccacaagacttaaaaatcaaggaggtgagtcaacaaaaagaaaaaaataaaaataaatgagaaaccatcaaattagaatatactgtagcaaatctcaatatatttatgttttatggttttatccatctttatttcttaattatgttactactatacaactatatcctaatacatttttaaaaatcaaacttcatggaataaagaatacaacgtaaaaatccctcctcttttttttctagcatattcagataagcaacataggagaagcccacaccagtacctgttgccatgatatatatatttcattcataacacagacagatacagccatgtttcgtggctgtgtgtatgcacttacacattcatatgtaagtctggaaggtcacaccacaaactgacaaaagtgattacatctgggtgggaaaattttacctgttcttcttcatattttattttttgaaaaatttttcaataagctttttttgattaaattgaggaaaagagtgctaaaaagataaatataatgaaagatacatcttcaaagtggctacctttattctttcacccaacatttgctaagtgcctcctcggggcactgggagagatgtatggaagctggccaaagctgagtccagaaatgaagcctgagacaacaggcaaacggcagagattgtcccttgattaactattatctctacttccagggtgcgaacgttacctatgggtcataaaatttgaagctgtttcatcttccaaaatcattggtcagttttgaacacagttgagttgaatattatagaccgtcaatcataatttcacaagtgagttgtcagggagaaaaaaaaattcctattgcacttggaaatgtcaagtgtaacccaataaatgtcaaattaaattgagctgtttgtgggaaattgtttagagctgtttataatagggggaaaacatgcaatcatcctaaatgggtatatgaacaggaagcctgggaaataccttccgaaaatatgaccacctgtatctattaagaattgtgtttgtgttcctgaaatcaaggatcctccctctctggtaccttgtaaggtaaatggtgctaacttcttctgaagaatacttaatcttttaacacttggatatccagtcacttttctaataaagatatttctcacacatgtatctctgtgtgctgatgcaaagggagttactgcgcatgtcaccaacgctggttagcactttctttagtcattcccatggtggtctttttctcaagagtaaagtccaaaaatgcagataaattaagaaggcacaagatcaaaagtacgtagtacccagctatttgttaatactgaaaataagacttggtaagcagatgtgtcacacacatgtctatggtcaacataatggggctgtcttctgccatatttgtttgtcaaaaggactggaaggtctgtcaatgagaagtgactttctctggacacttaatctttctctaagagattaaacattcagtattttttagaagaggagggcatgcaatgaagtgatggctgcaattctttgctttaattcaatcagtatttactgagcactttcctgttgcaagttctttgcaccaaagctgtgatggtgaaaagtgagccttgaacttttcaagctcaaaatcaagttagggagacagatgaaaagaaaacaaagacaaaagaatgcatgatgtataaagtgcagtggcagcatctcaaaatgacgcctaactcgagtatggaaagtcagagacacttcttggagtattaggctaaggagatgtgagcactaaagtacctacgggaggaaagaataattatagaaagacccggtggtatttaaggcaacttataggattcagtcaggtaaggatgacttctaacaatacagttaatcaccagacatgcatttaatgtgcagaaatggtaaatcagtaagagttgtaaattagctcccaaaaagtcagagcactaaatattaacttacaatacccaaattaagaagccaaattaggaactctgtttagttctcaggttaaaccaagctagatcctttgaaagttttgtacttaacacttaataagtaccagagaaattttgccatgtgcatggcatattaatataccatatttctttaaaaaaaacttatttaacattcaggggtacatgtacagttttgttatacaggtaaatttcatgtctcaggggtttgttatatagattttttgtcacctaggtaataagcatagtacctgataggtagttttccaatcttcaccctcctcctaccctccattttcaagtaggcctcagtgtctgttgttctcttctttgtgtccatatgtactcaatgtttagctcccacttataagtgagaacatgcagtatttggttttctgttccttaggatagtttgcttaggataacggcttccagctccatgcatgttgctacaagagacatgttcttgctcttttttatggtggcatagtattccatgctatatatgtaccacattttctttatccggtctaccagtgatgggcacctaagttgattccatgtctttgctatagtgaatagcgctacaatgaacatatatgtgcatgtgtcttcatggcagaatgatttacattcctttgggtatatacccaatcatgggattgctggttgaaaggtagttctgttttaagttctttgagaaatcgccaaactgttttccacaaaggctgaactaatctacattcccaccagcagtgtataagtgttcccctctctccaaaatcttgccagcatctgctatttttgactttttactagtagccattctgactgactacaccacacatctaaaccattcattttggtggaatgacattcccctcccccaccaaaaaaaacaccttttattacatcacacgataattctcccataaggcaactctcagtctattcattttgatgtttgttttcttccatcaaacttccatcacctccctccagtaactcaactgtctcagggtagtgaatggcagttacttgtatgcagtgacaaaagggaaaataccttacactgtctttcttttaccactgagtccatgacatacctccctctcctctgatgcctcagcctcccactgagactcaccagtggccttggtatgttcaatcaccaaggctctgggataccacctcctgccacaccatctctggccatgccacttccagcagagggccaaacctgctgcagatgcctctgtcatccattgccctgtccaaattccaacttggaagagccaccctagggagagccaccatcctccccgcttgcctgcctcctcactggtctcctgcttctgctcttggctccctacaggccaatttcggctcagcgaaaggatccttttaaaatatcatgtcaccttgagctcaaaaccactgcagtttctcaaagtcttaatttaccataagatctagcaatttcactgctggggatctacctgttttagtttacttttgctgtcgtggcagattattacaaatgtaaaggcttaaaacaatgctcatttattgtctcacagtgtttgcaggtcagaagtctggcaggatgtaactggattttctgtttagagtctcaccaagctaaaatcaagctactggctggaactatgattcttatttgcagcttagagacttcttcccaccttactagttagtggcagaattcagttccttgcagctacaagactgaggtatccagttccttgacacaaggccctcatcttgaagccaacaatggtacatcaaatccttctcaggcttcaaatgtctttgatttctgctatacctctctaaacttctcttctgacttcctctacttcctcttgtgcttttaagggcttatgtgatcatactgggtccatctagttaatccaggataatctcctgatcttaaggtcaactgcatagtaacctcaactacatctgcaaagtcctttttgccatgtaataccacatattcaagggcacaaaactaggggtaaaagtcttggggccagaattctgtctatcacagcacccaagagaaataaaaatacattccacataaagacttggacataagtgttcatagcagcattaatcgtgatagccaaaaattcaaatcaacataaatatctaccaattggtaaatggacaaaatgtgctgtatctatacaatggaatactcttcggtaacacaaagaacaaactattaatacattcaacaatatgaagtaacctcaaaaatatgatactaagtgaaggaagctcgacacaagagaccacatgctgtagcattccatttaaagaaaagacaaatctatagggacacaatgcagattaatggttgctggggctggcaggagtaatgggattaacagtaaagggcataaggaatcttattggaggatgaaatgttttaaaactggactacagtgatggttatataacttggtaaatttactaaacatcatggaactaaacttctttcacttaatatcatgataccatgtttttgaggttcattcatgttgttgaatgtattaatagtttgttctttgtgttgccaaagagtattccattgtgtggtgtattagtccatataattgaatactctctggtaactgctgctataaagaactgcctgagactgagtaatttacaaaggaaagaggtttaattaactcacagttccacatggctggggaggcctcaggaaacttacaatcatggtagaagaagaagcaaacacatctttctttacacagtggcaggaaggggaagtgccgggcaaagcaggaagagccccttataaaaccatcagatctcatgcgaactcactcactatcacaagaacagcatgagggtaactgcccccatgattaaattacctcccaccgggtccctccccaagacacatgaggattatgggaactaaaattcaagatgagatttaggtagggacacagccaaaccatatcctatggatacagtacattttgtccattgaaggatatacttgaaatgggtaaattttatgatatacaatacataacttaattagcttgtcagaaaattaaaaataaatcaataaataaaaccattgcaaaagccagcacccctctagttgcatacagagccctacaggttattctccatgctccaatttcacctcatgtcccacagcttgcttgctctctttctctaatcacctgatacctccaggaacattcctgcctcaggaactttccaattgatcccaccaatccagtccttcgaattaggttaaagttgctttggctccaactctctcttaaattagttgtgaaaacacatggtcttgaccatggaaagaacatgaagcggacactcagtgctcctctctgctccctttgtgctccaatgggataagggaacatataatgaaaaatgatggcactgtaaatactggtacaagttaagtattatgatgcttagagagcaggcaaaggacattcttcagaacacggatattccatcatctgtctccagctgccactggatgccaataagccactagaatgtaagagctgactacaccaggaatgtacatatcaccatcatgctgatgcttctcccagctaccactcatgttcccttgtccaccaagagtactgctttaggctgggcgcagtggctcatatctgtaatcccagaactttgggaggctgaggcgggcagatcacttgaggtcagaagttcaagaccagcctggctgacatggcaaaaccccatctctactaaaagtacaaaaaattagccgggcatccatgtggtgggtgcctgtaattccagctacttgggaggctgaggcaggagaatcgctcgaacccaggaggtggaggtagcagtgagccgagatcatgccactgcactccagcctgggcaaaagagcaagactccatttcaaaaaaaaaaaaaaaaaaaaaaaaaccaaacccacaaagactcctgctttatttcaattattttccctgatagattttcctccacatttgtaaaataatgctgacatcaaccagccaaaaaaatcacacccactttatcagaactacttgtgcagttaaataaatagcatgctacttccaaaagaaacaattacttctattttttaaacaaggatgaagcatcctacttgtaattctcaatgatttccgcagagatcaagtgaggctccttctttactacagccaaatttcccaccaccagattcacaaggcagaaacttgagagttcagtgaatagtaccagttaacctcagagggctgttgtagtttctcagtaagctcctggaacaacctagactgcatgggacaaaattttctttttgcaaatgatgtgtttcattttttttaaaggaagagctatgaataataatgagattcattgatttcgagagatcagaaacaggtaagttttgtagcagagtctaatgtgccaatttcagtccttaggcagtcaattaatctacccttcccaattggtctgatgttcatgatcctatggggtattttttaaaagtaagtaaagtaagtattctaaataaagaagattaaggatgttgctggcttcttctatttttatatgttctgttggatgaccttttgaaatgctctagaccaaagttcgttgcttttggcttaaagcagcacagtatggtggttaggaacacagactgggacaggtggaggttccaattccaaatgtgacatttactatgttcagagatttaagtaacttgttcaaggtcacacaagtagtaattgacatgaaagggatctcaaccaagatagtctgactcctatgggcttagtcagtaccctaagctgcctcccatttactgttactgttcacccatcaccaccacgactatcctcctcctgctcctcctcatcatcatcatcactatcagacagccatgttatagataacaattaaaactgttattaatgtatccagtcttgaacaccaaaaagccacattcagcaaatgtcatccaataaacagtcaccacatccattcatttttctaatgctattccagtgaactagggaagaaaatgtcataaaactcattttacagaatggggaactgagctaaaaatgattacgtctcctagcttccctcggtgactgagaggctgagacagaactggtgacactcggctctgtttgcctggcattatcactcatcttaaaaatatttaagcttcccaaatgaaaataggtaggactgtttctagccgtctgatctacctggagacaaacaaggccaagctggcttgctaagcacattggaataaataaagtattaagacatgagtgagggcctatcatacagaattcccatattgcgtctgcagtcagcataataaccgtggcatttcttttcgttctgcattcagcctggctaattcagtgaaaccttaaaagtgacaaatgaatgttgaaaaagagctggcatttcttccaagatttgagaagatgccagaaggaccctaggaaagtgcagtgacagctggaatggaggaggacagagtttaaaaagcaacttaccacttattttttgtgtttaatttttatattaagaccacaaaaataacatgagattgtactgaaagaaaaaaaataagttttttaattgtacagttaatatttctaaattagccaaaaccagaacgactgtcaaatgtgtcaccaaagcctataatccagtccctatggcatcattcattgacaaatatttttatccatttcaaaacacataaggaaaaaggaaaaaagactcttaaagcttctaccagacctttaaacaggccctaaaaaaatccagagctttataatattttcctactactttgttacatgcacatttgccaaaatttccctaaaacaaaccacttaaaattaataaattacctgtcaaatcccataaaaacagatggtcacttagagacaggagaagatgctagcattctgttttacacagatgttcagactgggaaaagatcatttcattttccataacagacaatgaaccttgtctaagatttccaatattatgcataaaaatgaaaatatcatgcagctgcttctatgttacacatctggttactgttgaagaaacatctttaatagtaaaatgaaaatcattataataaataagaactaaaattggtctttgttttctcttaacaagtatcatgctacttgtaagtcctttgctatcaaaaaattttaagttgctaaatgctcctaaattgaggtactctaatatgctatttaatgcaatcaagaattaatcagtaaactcctatccataagaaagtacacacagctgaatatctgacaccccaactgtttcttcctgttactcctttcaagaaggtgttttagtaattttatcagaaatctaacacatgaaacaataagtcaacacaacattagtgtcacacatccgaaatgagattttgacttgttagtctccaacacattacttacattactataaattgcatgaagatgaagacatttggcacctaagaatagttatgaaatacccaacaccaagagcatgcctgtatttatgctcagagctctcttggttctacatttttagcaaaagacatgaaacttgatagctaaatatatgaccactttttcacattacttgccaggagcaccaatgtttaagtcttcaaaatgtctacaaaatatattggtgacattcaactactctaagagatggggtatgtacagcagggggattcatttaatattggcaaaatgattacaatttggacaggctactttgggttaactgttaagtactgaatttgatcagaagttttcctaacaatcccttgtttaaaatatccagtggatttcactggaacaaaatccaagccccttacagggtctacaaggctctggtgacctctaagaccctgcccatccctctaaccccatctccttccactccctgatgccatgcctccatgatcatctttctgtcccttgaagtcaccaagtacctggccatcacctatgtgatccacccacttggaatgcccttcccttagatcttcttgcagctgttgagcattcacatcttgcatcacaatgtcatttccacagggaagacttctccgacccttggtcccacccttatttttccatcactatctcactaccctcttttatattattcatagcattgctaacttgagaacattatattgtaagtctttacatggttttctgtcttctctcactagaattcgaagccgctcccaagagatgccttactccagttatatctccagcaccaagtacctgtacataatacctgctaaatgaaggaacaaactgcttttcattaaactgactaataatgtgattgaagtggccaaacaatccaatggaatccaacttgtatcttggataccccactactggcctcataattagacttaaccatggaatgaggtgataagtcctcaaggcctaagggattgtccagagcctatatatcccctgccatgcacattccccagaagtctaccgaaatggcccattgtgggcctcttttcaagatggggccttccaagggaagcatctgctgtcctctaattatactcctatgctcaaggggtggctgtgtgcaggagaggtggatggacctgaacacacatactcatgaggcacctcacaacgcacagtgaagctgggggcggaaagaggaaccacaggctagggggaggtaatccctaatccctgtgctacatgttcctgcactaaactccacaaagtccgggaatgcaaaatggaagccaggccttacaggtcactctgaaggtatgtttgtcagggcaagacattttattcaatttgggatatactttagtctacttgatacagcattaccttgatttatatatgcatttatgaaattttatattttgaacatatggtgtatgggcctctatttgtccttctgcctctggtcctataaatgttagggatggggcctaactgctactctgagaacttgatcaagtacctcagttcactgagtctgtttcctcatttcagaaagagaaataattcctgtcctgtcaacaccttatattatgtgaagaacaatacatacaaataaaaaacataattttaaaatatttctattatgttctttcccacatacctccctgtgtattccagcaagtgagaatgatgataatttccatcaccaattccaaggcaactgtggcttttgagaaacttttgaactagacaggtgatatggttttggtgtctgtcccctccaaatctcatgttgaactgtaattcccaatgttggaggtgggagctggtgggaggtgtttgggtcatgggggaagatccctcatgaatggcttgatgccctccttgcagacgtgagtgagttctcactctgagttcatgtgagatctggtgtttaaaagactatggcacctcccacctcccactcgtgctccctctctcaccatgtgacatgcctactcctgctttgccttctgccatgatattaagttcctcgaggccttcccagaagccgagcagatgctgataccatgcctcttgtacagcctgcagaaccatgagccaattaaacctcttttctgtataaattacccagcctcagctatttctttaaaacaacataagaacagactaacacaacagggtttggcttttcaccgccttttcttttagtgttaagtactctttacatttcttctccattctacaaagtttcacatctttccagaaggaaaagatgtccaactgtctaagactttggacattaagagagagagagttctttaacaaaaatttctaaagtaaaaattaaaaaaaaaccttttctaattatttacagttgtagagaggtgccaactaaaaaatatctcatctcctatttagtctattgaatactgacatgttttccaggaaaagtacataatatacactaatgctgtgcatttattgatctctaatcggttgctggaatgaactgaacaagaaatatacccctggggctgttttagatctctctggctgtctgtctagaagcctttcctaccattccagagaaaggatggtctcagagatttaataaatcaagagcacaaacagcgcatacaaggaagctaggacaaacaaagagaaatgcaaaatgagctggcaggtgggttagggtatagcagtagatgaaacagactctgcagggcaagggaaaacagaatgagttttcaatggactgagattgaaaaagtcaaaaccccttttcacaactgatatggttttgctgtgcccccatccaaatctcaccttgaattgtatttcccagaattttcacgtgttgtgggagggacccaggagaggtaattgaatcatgggggccagtctttcccctgctattctcattatagtgaataagtctcacaagatctgatgggtttatcagggggttctgcttttgcttcttcctcatttttctcttgctgccaccatgtaagaagtgcctttcacctccagccatgtttctgagacctccccagccatgtggaactgtaagtccaattaaatctttttttcttcccagtctcgggtatgtcttcatcagcagcataaaaacggactaatacaacaatacgttagatctatcacatggagtacactagtcactgtggaaaaatcataaactgcctaaaactaaataatagaaatctatatcacattcccctttagagttcatcatatcagaactttccaattttctatgtaattaaatagttctaccttgtctctcaagtctacaaatcaaataaatgcagcaggaaacctacctgtaaataataacagcaataataataaaggagttaacatttattgtcttttgtattgattgatttccatacactgatctgagttatcgctattaatttaatgaggactcagcaacaatctgattcaagaaatatgattagttcctttcatagatggggaaacttaagacacaggaaagttaagaagcttgcccaagatctcatgtgggaaaattagaagaaaagtatttagaacccagaaggtctggctttatagaggcagccaaatggttcagagtgtaaggcacagagtgaagaactgccaggaacttgacacttgatcagccagcccttcaacaaatctgtgttcatcattatcacattcaagggtgcaaggaaaaacaaacaacacaaataaagctaatgtgaatccaggcctggaaactcactatcctagcagagaaggaagaagatcttattgataagaccttatggagcaacttcaaatacaatctctcatatgatatctcttcacaatgtccctgaattgctattcccagttcatagagaaagaaacagagaccaaatatgccgagcaagttattcaagattacaaaagtattcagtggcattccccacatatgaacaggtgttaattcaatattaattcaaccagcatccccaaatagtctggggaataggtcctccttgttattcaagacatcaactcaacaagtgggaaaagacattggtaatatctaatcgtaagcatatgtaactctcacatcctccaaaaaaaaaaaaaaaaaacaacaaaaaaaaactgaatatcaaagccacagctcaaatccagaccttctaaatcctattcaaatattgtttctaccacaccaggtacactgtcacctcacgatactgtatagaaaaacccacaatgtaattataaactgtaaatcctgatgggttaggccttgacaaatcaaaatgaagaaaatacactcatttcccaatgtccatggcttccttgcttactatagaagcaaaccactatggtgagcctaggtagccaatgaaggctattaggaaaatgacctttgttagtgacaaccattcttctgatacaatttgtgtacattactataggtccaggtggatatacgtcaacctccacatttattccatcgatttctttaacatggttttaaagatagataccacattacatgtctataatatataatgtatttgcaaatagtggcttgttattatattctcgcaataataactaaaagttgttattctaccctataggatatttgcatattcaattggtctaacacatatagcacattcaattgtgtatccagcaaatagcatatttaattggtctaacacatccccaatgcctaacaactaaaagttgttatcctaccctatagaatatttgcatattcaattggtctaacacatataacacattcaattgtatatccagcaaatagcatattcaatcggtctaacacatccccaatgcctttcttcaactaccccatcccaaacatcaacaagtcccgagctgtccatccaaaacacatctcaaagacatcagctccaccacatctcccgtgtaaacctctcattcacaccaccatcttctctcacttggaagaccataatgacagctgatctctttctcacttctcctgcagccccattaatctatttaccacaggacagtccacagggtgaccgactcatcctggtttgccttaggctttctcagctttagcactgaaagtcccatgttcagggaactcctcatttttgagcaatcaagagcagttggtcacccccgactatggtgaactttttataagatagataagatcaggtcattgcagaaatcactagccccaattcctcatctctccctggatccatgccattttccaagtgactatgcagttcttcccactagaggccctgaccccttgtctttggattccaacaatgggatattagcagatgtgatgcaacaaggagcttgaaacatacttgcagttgggcttgctctcttgcattccagccacttccttgtgaaaactatacccacacctagcccacaagtccgaggaggatgagaggcacgtggtacaggcctggacccaacctgcagtttgcagccaagcccagagagggccacctcaacccactaatatgcagacacttgagcaagaacaaatgactccctgagtttggggatggtttgttacctagcgttgttgaggcaatacctaactgacatggatttcatccaaatcttttggtagcttcccatttcacttagaataaaatcaaatatacttagctgagcacaaagccttatatgatctgggctccaacccatttgccagacctcaccatactatccttttctaaacttcattctcaccgatcccctttctgtttatcaaattgataaagctgtttctagttcaggatctcggcctctcctgtcacctgtgcttgaaacactttcatcccagttctcatgactggctcgtgttcatcctcacaggtcagcttaaaaatcacctcctcagagaagccttccttgactatcctataacatgaaatctgtgtatttctgtcacagtatttctcacaatctgtcaattatttgctaatttgtttgcttatactctgcatcctcaccaagctcaaatattcaaactattttctgcatatgttagtggataccaattgaatggtacccaaaagctcagaaaatcccttagcctggtaccttctggtgtgatgggtaaaagatttttattattgaaaacagaaagtgaaaatcagtaagatagtaaagctatagatgacttttagcaatcattgatattgttttaaattaaaagttcaaaaggggtttgattttttaagagttagctggacataacttttttaaaaccagaaagaattacaccagatttttagttgtatcagtctttccaaatgaaataatacctcaagatcagactccaataacgataccccctccccaccaaaaaaactactttgcttaagtcaaaggaagctgaacaaataaaaatttgtttggtgtggtatgaaattacaagcctttagtgacaggagtaaaaacggaagcaatgaaagtatcattctctatcattagttatacttccatactactggtcatgtggaaaattttagctattcacttcttggcagggacttcgatgttcacaaaagacccctttaaactccaaacactgtgaagttaaaaggcagtgaatcgtgaaagtaggtgtgtttctatattgagaatacctgtgtaatgtgaaacacaacagaccagttccttgttcagctaaagggggctgcttgcagtattaaagacagaggtgaggaggcaccagggcttctgagagttttgactaataaaatcaccccaagaagggaagacacagaacgtcagccaggcctcaagcaggaaaggagtgccagggtgggagtctgcccagtatagggagttttgaattgacctttgggagaaagagggtgtgaagagatggctctgcgtcctaagcgaaggtaagcaacctcatgaacatggctctggacgctggaggccctggtccctggactttgggcttggaagcaaaggccactgactgtttctctatcactctgagaagctccattgtgcctgggcctcttagatgattattttataaactatggattaggacaatggcatatctcaggaagggcacatgaggattcagtgagataaagcaggataaacacttaacagtgtttattacagatacactgagttttcaaaacatttcagccattgtattttctaccacctagcacacacaccagatcaatatttgatgagagcataagtaaatgaaagtctaaggttttgttgaaatgtgctctttgtcttgaaaaggaaaagaattgcataaaggtaaaacaagatgaatgtgtctcctaagacatcaggatggcagatctgaacattctagtcatgagaaaatcattccattttgtaaatgtgccattggcattctggtgtatacatcattctcacaggcttggttgatgaacatccaacctccttagtttgatgaactctgggtgggtacccacaagtttcctgacctaaaaggcaaggagtggtttggtttatttaaagtagtatcccttgacgggttgtctataggatctatctcagaaagcagccttctacacttccatcggaaaacacctctctcttcccctcaacacaagtaactagctttacatacaaacagtaagatgatcacagttattacttctctgtttaaagctagaattgccaacttcctgccaatcattttgaaagataattttcatgagagccaggagaaagaaagaaagttaaggacaaggtttctattctgggtcagaaaaaaactctgtttgttaaatgtattatatttaataatgagtcagaaagggaaagtagtttttgcctcttccaagaaggcttccctgaccacccagcatttacagtggaataggcatcccttttccctgcgtgccatgacatctgggcacaccttcactactcctgtatccctatgagtttacacatctgtctctctaccaagcagtgaacgtcttggaagcaccaactatttgtagtcatccttgtgcccaaccaacctcagtacctgattatttcaggtactcaataactgttaaatgaattaacgtcccattgaaaagaggttacttaaatcacagggggttttgagccctctcatggtttccttatagtcccctcacttataacacacacaacactggcaaggatggagagctactgtctaatactgagcaatactgatgttttttccagaagtaggggaggcagtgacaaaaatggcactgagataagcatatttgggacacctttaaactgaaatgagcacatatccaaagatcctataactgaaagtagagctcatcaatgtaaacagaacaaaaagccactatggaccagggacttttgttaacatgacctgccagggatcagagagaacccacagaaggtgaagctgtctttgtctaaggagattcattcctggtaataccagacctaaccatccccacatttcaactaaggctgttctgtggcatcagacaggaggatcagcctgaagagaaccctggacataaggctggcaacaggcaaagacaccgagttgatgtgtcccttcttaatttcccaacttcccaccattgcccacagggctgctgcttccttagttttaccttctcccttaaacaaagcttacaatcatgacccaatgacattagagaaagtcactgggtatgtatacaccagaagtcctgcttggcaacttttagcctagatggagggttcctggatgtctttgttctcttattaactcttccattcagtaatcacttatggaattcacactacagtccaggtaccaggaatgcaaagatgaatgggaaagttttagccctggaacaaatccagcctcgtcctccctatctatttctgtaccccactcccagtagtcatcccaaactgtctggaaggccctttcttctcttgttcatccttcatttaaaagctgcaagaattgatggaataatatttaaagctctcatctttggccgggtgcagtggctcacgtctgtggtcccagcactttgggaggccaaggcgggtggatcacaaggtcaggagttcgagaccagcctggccaatatggtaaaactccatctctacgaaaaatacaaaaattagccaggcacggtggcgggtgcctgtagtcccagctaccccggaggctgagggaggagaatcgcttgaacctgggaggcagaggttgcagtcagccaagatcgtgcccctgcattccagcctgggcaacagagtgagactccatctcaaaaaacaaacaaacaaacaacaacaacaaaaaactctcatttccttttcctttttttttggagacggagtcttgttctgttgcccagggtggagtgcagtggcacaatctcagctcactgcaacctctgcctcctgggttccagcaattttcctgcctcagcctcctgagtagctgggactacaggcgcatgccgccatgcccagctaatttttttgtattttagtagagacggggtttcactgtgttgcccaggctgttctcgaactcctgaactcaggcaacacgcccacctcggcctcccaaagtgctaggattacaggtgtgagccaccacgcccggccaaaactctcactgtctttcctacaaaacaggcttcctgttaaagacagctgctatcaaagagtcatccttaatcttattcaggtaaccaaaaactttattctttaaatggagacaactttgagagtaaaagggatttgcagttaataatagttctggaataacagatgtatccaagtctgtcccaggcaaaccaatagggatgatcacctacaccgaagagacagaaattctaagcttaaatgccagatgaatcttgaaacctgtccagatttacagaaacacctatactttattttgtatatgaaaagtatcgtgtgaaaggtcacctcacaactatgttgtaaggaatatgtttcctctttctgggtacagaggcaacaggttaaattacaacccctgcatcacccagtgtatgctgtgatgtggaacacactatttaccgtaacagcaaaaagcacatcatctactgatgtttcctatgagccagagactgttaaggcctagatcattcctcccaccaaacccatgagtagacactactgacatcccacattttacagatgaggaaatggagccttcgagaagttacagcacagctaaaaaggatgggactatgcttcaaactaaggcagtctcttccagagcccaccttcttaaatactaccacagtgccttctcaaagacatcactgaagaggtgataagatgagccacaaaaactgggagatcgtgacaatgataatgatcctaactacccattattggaaactttagggtatacaactctgctaaaccttatacacagcatgatctcatttcactctcctggctctcctaggaatcattattactaagcccattttacagatgaggaaactgaggattctagaggctaagtaacttgcctagggttgtgaagctatcgtggagcaaatgcaagatttgaattcaaggcgaactccagagtcatcctcaccatattagaaggtgcactatgaaagaaagaatttggacgaaggcaggaaggaaactgatgtggccacacactgggtaacaggcataaagagaggacaatgagcgaaaggtaaattgtgactgcgtcatgcacagctgactgtgtatgccacagtgagttaaaactgaatccactaaacaaggaacagtagtaagaaattctgagcaagagtgtctcaacgggatccaggttttctcatgtttatgatgctaatggacagatcatttataaagaaaatatatatttatgtaaagttgtttttcagtgctgcatctagcacctgaagattctgggaacaatttgatttttgcacatcaaatacctttagcactgttattttccccctgttatccacgtcccatctgtttcctctgccccatgctgaagtgactggtatatttgctcaaataaaagcctgaagacaaaaaaaaaaaaaaactctaatacttggctcacatttaatttgagagaaatagactcccaaatctcttagcttgttcgatgttgaatgaaagaaaaaaaattacacagctgagatagcttgtttacttacccaattttcatcctaaggtagatcaagtaacacaactcttttaaaccttctcaattcatttcctgacttttttgtccgtaacctagaaaactcaagtacagccttagtactatttatgaacatctgttaaacattgccaatgcctgttacaaccaccttggggaatagtgtagcatcttaaaagcataattccatatgtaatatttattctgttgcaatgtaaagaaagtatgacgctcattttctttaaaaattatgcaacttttgacttacatcttcatctacttagaaaatatcaaccaacagtacacaagtcattatatattcattatcaagttatctgacaagttgtataaaaaaacatagcttcacacttgggtgttattgcaaaagtattgaaaatttttatttttatctgctgttgatgttttaatagttgttttgtatttctttcatgacggctcaaaacactggctcagttcaatccaaaaaaagaagaaaaaaagaaagagaacttggtgagtgcctcatttgtgtgaaatgtgtttcgtttatctttgttgccatctcaatcattccttgaagtatgtattattatcccctattttatagtcaagtaaattgtggtttagggtaatcagtcaaagtagggctgggatgggagctctgttctgactgtatagcctgtgtttcttctaagccttgaagcaaagagacaaagattttcaagattctaaacactactttcagaagagaccactacatgatcaccaaacccatttcttctttttcctaagcatggattgaaactgtatttcccagccacccttgaagttggttgagatcttgcaattacttttagctgaaatgacacagtccatgcaaatttctacatgcaatcctccatggtttttttgccttttgagtggctggaatgggcatactttccaggtcatctttgggagccatgtgtggaagacagcagagtgaaaaacaaaaggagcctgggttcctgtggcagaccaagaacatcatgctagatttgtatgtgaataggaaataacttcttcttgcaccaggctactgagaatggggcagctcatgtgcttcagaagctagcactacctaatatgccaatacagagaaaaacaatccaaaaataaccacaagaggaaataacacagtcaatctagagattatcataaaaccttaaaataatattttggaaaaaaatttaatatttagacaatgttcattttataatatagaattttaaaacaaaaattataaacaaaactgtacttagtacctcaccaaatttataaacaagctcattctctctcaatgatgtcatatacatatgtacacagaaattaatattgctgaatgcatgtgtgcaaaacaaaaatgaaagaaaatatgttaatattagcacaggcttcctctaagtaatgagattagaagatattttttacttattttttacttttttgtaattttctgtattttccaatatcaaaataatgagcatgttcctttgataatcagaaaagatttgtctaattatgtttaagatttctttaaaaggggcaatccacccagacagagcgatcacagcagtgaggtcctatgtcatttaccctaggtaaagtttttctgtttttctgcatttatagcccataaagtaccctctgaactttcaaaactgccaaactttacaatggggtgagtcaaaggcccccagggtaaaatatttcacgggaaagtcctggaaaatgagaccacatgccaacataacttctttgcccattctcaatgaggtagctttaaaaaaacaagtcggccaggcctataatcttcccaacttggcctcccaaaggccagcaatttgggaggtcaaagtgggaagatcactcgaggccaggagttcgagaccatcctggccaacatggcgaaaccccgtgtctattaaaaatataaaaattagctgggcatggtggtgcacgcctgtaatcccagatactcaggaggctaagtcatgagaaccgcctgaacctgggaggcagagattgcagtgagctaagatcgcaccccccaactccagccggggcgacagagcaaaagtgtctcaaaaaattaaaaaattaaaaattaaaaaaataaaaacaagataatacataactgcattaatgacacaccaaaaagacagaaagtaaaattatgttagttaccatggatacacaatcatgggcatgaagagatctggtgacactcagtaccagtccttaaaggaaagtctttccctttggtttagatgaagattccaggagataatatttatgaaatgctcagcacaataccaggcacatggtaaaggcccaaagcttaaacaccaccactattatttttattggtaaaagtgtaagaagaattaatccttgctttagtaggctgttaaaattgaagttaaggcattgagtttcaaagtactgttctcatttgtttctgagaaaactgaaaggaagctacatgtacactcccataaagcctgcctgcccacaacccgccttgatctcgcccttcactctgcaggtctcctgcagagtggtattcagtgaataccacaagacacttagggaaaagatattctagcacagagaaattctaaggagatgaccagagaagaccatttatatttgcagacttaggaagaagaaaaaagaacattttataaaagggggatctctttgcaaaaatacatacaatagaaaatgtcattaaaagctacaacttgttgaatgggatatcctctttataaatacagttagggaaaaccattaatttaaattcaggtgctcctttaaggagcatttgcaagcgagcatgagcaagtgaacattttctgaataacaatatttattcgtgagcacctactgcctctgaggacctatgagaagcactctatctgcatgagaccaggttcttagcagcaagcaacagaaattaactctagctcaaataagcatgaactaaattacgaaaaagaaattgggaggctcacataatcaccaagaaggcaggacaatcagacttaaaaaatgggaaggaaccaaagaggccaacagcaggcaggcacacaatcaaatcacaccacaggaaccatctgtctggtgaggacaccactgttattcctagaaagcagataccgcttcaacctctcatggaccacatatgccattaccctaggagcagctttatattattgactccaaagtcaaaataatgggcagctgatatgttggtaaaaggaaaacttacttcacaaaaatcaatgttatccttgtctgtcattataagacaaaaatgaccgtcatctcaataaaaaggatattaagatctttttgcaagatcctaaccacatgtcataggacaaagccacaacaatcaaggaggcttgcaatgtatttaattgactatgggattaatagtacatatcaatcagtagtcaatgcacaacagttctttttttacatcaaatacaattccttaatggtgttaagtaattcaccaggctttaggatgtgattacataataccaaaagaacaagttatcatattgacgaatggaaacatgttatagctgaaagcaatcaaaagctagccaagttcaataaaagctccttatctccattttaggatgcatgtcattaggccagagaagattaatttctccattcatagttcaattttctttcccaacaaaaaataaaactgagcttttgaaacgcaattttcttgcttaatcaaatggtaagagtctcatgtcaacatgtgtggaataattaataaattgtagagattctaaaaactgaaagatagtgatcctagatatgtttcatctaagtttatatacaaatacttttttaagacaggtatttccagttatatgagagacacaatccttcactcactttcaaagagaactgaaaaggtaacatgaagatcagtcattcacacagtaggtattctgtaatgatctgttgactgtattcattaatttaatccataagagaaaaaaagtatgtacttataagcctcctaagaaaattgtatgcaacgtaaacaactcctcctttaaagcgtgattataaaaggtggctccgataaatggcagcagcaatgaatattatccacacattaaaaacttaattcaaacaaatttgctctctcagacataaatccattttctatgcaagaaaatgaggatctcactcaatatcttaccattatgaacagtgtttcagaaacaaaatgtatgcattacccattttaaacaaatgttcaaattaacaagctttccataactacacagcaaaaggttctatttgctcagagataaaagcaaatgaatcattaagaaaatatctgcagattgcagtttctatatattgcaccttaaaacctgccacatctagttttaatccaatcttctaattttattaatatgcattttccatgtttaaaatgctgacccacacataaaaatctcccaaaaatatcatcatcaagttagcaaaaggaaaatgctaggggagatttaatctaatctgactggattaaaatcccatcatctttgtcatttagctctacaatctcggcatgttttttaactttatcttgcctgtttccttgcttgtaaaatgacataaacaatgactgaatttggcgaccaactgaatatagtagacatgagagacattaatgatgcagagctatttcagctgggtaagtagggtggcgagaagaagagaaggtttgaagcaaccaagagatgacaagttccatttaggtcaggtgtgccaaagacactcatgaacaagtggtcaacagacaactaggaatgcagcttcaggcacaaagaaagagatctgcgagacaatccgcagagaagtcaccctggaaatcacagatatgattaatgtcacatttattttcaaaatattttataaaatgtcatttcaaaacacatcaaaatatgaataaagtaggaaggtaagcaaatatctttcaattatttacaaatctttctaattaaaatatgaactctcctaacacatgattaacaggatagttattacgatgtctctggtctctctgtgagttagaatcacaacagtagtgaacctcctggaatttgctgccactgacaacaatgatgatgctgatagcaataaaatcttatatagaactttctcagtgttagacacataatcattctaggcaattttctcccatgatggtatcataattacaaggtgaagatcccattttttcaggacaatcaggaagatgtgtgcataatccagttttaatcttaacctcaaatctatttgctaaaacttcaatcgtgctcttggttctgtcaatcttgtggtgacaagaatgtaaatactctgaagttttgccagattcttcttgctttgctctctccaggtaatctcagtgatgtgcacacaatttttatatttatgatcaactaatttcacttttaaccaactagaattggttccatatcctcttctaatgctataaatttccccttagatcaaaactattcaacaacagaaatcagaggagaccttccttctaccaaaactactcactgagttcgggaaggattactcattcattcaccaaataaggagcttgaattttccaaattcctgtttagctctagacagaatcacagggaggccctctgttggccataccaccttaaggagcatcatagatatgcactggtgaaacctgcatgcacacacactcacacactcctataagcacacacacacaaccatgcatcattctccattcctttatccagcttgattttgtcaatccttttatcattctcaaccctttatccagtttgtatttcttgagagcatacctgaagaactaattttcttttacttcaaattgctttattgtctctttttttccctcccttgtcccagcccaacacgtcaatgcaacattgctcattcctccagagcagaaattctattaaaagcatgatacagccaggtgcaatggctctcggttgtaatctcagcactttgagaggctgaggcaggaagatcacttgaggccaaactgggcaacacagagagaccccatctctacaaaaaataaagacacaaaaattagccaggtgtggtggtgtgtgcctgtagtcctacctactctgaaggctgaggtgggaggatcactcgagcccaggagttcgagattgcactgaactatgattacaccactgcactccagactgggtgacagagtgagaccctgtctctaaaagaagtaaaaaataaatacaagtaaaaagcatggtacacaatccccaaccacaatacaatggctaaataaatgttcataaaaccataactaagaagtcaattagctcactaagtgcatatctccaggaatatctcaaagagattaggtgttatgcctaagaggggtgaggggagtaatcagctggcctccagaattctctttaaaaaacttagttatacctgcaatgctagtgcttcactgtatttaagaaaataatggggaaatgaagatcaaagaccaacttgaactttacatttctttgctctcacttcccaatccccaaaccacaagagtataaaacaaaaatgatcctttcttatgaaaaggctggaatacagtactaacctttactgagtctattatcaaagttcactgaggagctctcatccaggtttagatcttattttactgggattttttcacagtaaaaaccaatcttgatagcttttaaaaatgaaaccaattttcatttattaaaatataagtcacttcaatttctacatttaacatctgaaagtcacaaattaatttctttctagaacataaattctatgaagaaaaagggcttgcctgtcttgcacagctgtgtccacagtgcctagtacatggttgaccctcgataaatatttgttccagaagagaatgcatatacatttcaactgacataacatagaaagggtctggtgtattagcatctggtagaactttaaaaagttcaaagaacaacaattactagctaaagtacctgcgacttactcttaaaagagcatagaaaattagaatattgaaatatggagagtgcttctatcctaaactctcaacctgtgctactgatacctggacaagactgagtagcagacgcacaactctttatttttagtgggaaataactgcattcccaaggctgaaggatgcacatgcaaatccttctagtgtccaaatgtgcactgtcctagatggtagccactagccacatcagtctcttgagcacctgaaatgtgactagtctgaaatgagatgtgctggaagtgtagcattccaaccaggtttctgaagattgggacaaaaaaatgaacacaaaatatcctgttgataactttttatattaattacatgttgaaatgatgttgttttagatatattggagtaaacagaatatattattaacattaatttcaccctttttttcatttttttaatgtgactgttagaaaactttaaaatactgacgtggctcacattatactcctactagacagtggcaatccagaccgacacctacaaagtctgtatgccacaggtggggatgctcactgaaaggcagacagcaggacctgatccctaatatctggatctgtaaggaggaaaatgagctagatgttctaccacacaacaatcgccctttgatatggtttggctgtccccacccaaatctcaccttgaattgtaataatctccacatgtcaagggtggggccagggggagataactgaatcattggggcagttttccccatactgttctaatggtagtgagtaagcctcacgagatctaatggttttataaatgggagttcccctgcacaagttctcgtctgccaccatgtaagacatccctttgctcttcctttgtcttccactatgattgtgaggtctccccagccatgcggaactgtgagtccactaaatctctttcctttataaatcacccagtctcaggtatgtctttattagtagcatgagaatagactaatacactcctaaagactcgcaatagcattgggaaataagtactattagctttgacctaaagaaactgaggcaaggacggagaaggtacttctgcagaattacaaagctggtaaagggaaggcaaaacactgaagcaaagttagcttgactttaaagtcatgcccttgtctttggtctcctccagtcactcagagggtgctctccccatgttctaagggacttaaagaaggatgtcgacaactgactcaccctgcaaaggcttctcaagcccttcagccatgtttctcccagccactaacccacagctgacagaagtgggtgaaatagtgactaaaatctctgaaaaattaccatgaagcaacatcccatgtgctgctatctcaggtaaaagaataaagttttcctaaattgatgttttttgcttttttaaattgcagttatcatttcctttattagttaacatggatcacaatttcctttttgtgttatcaaatattgttgaaggcttccatccactccctgcacacattattgaacgatgctccactgttgtactattcttcatttcaaaaagagctgggatgaaaacaccctaatgctcatactgtaagaatttctgaggatacaccctccctaagggatactgaaaagaaagggaagttgtttgttgttctaattttttttttttttttaagagagagaaggtctcactctggcgcccaggctagagtatgttagagtgatcatagcccactgcaatctcaaactcgtgggctcaagtgatcctcctgccaaagcctccagagtagctaggactacaggcatacaccaccatactaggctaatttttttagtttttgtagaaacgggttctgctatgttgcccaggctggtctcaaactcctggactcaagtgatcctccctcctcagcctctcaaagtactgagattataggcatgagccaccccactgagcctgttctaaggtttttgacacttaggccaagtgcctccagtgagtgatcctggcggaactgaggacacagaggtgcctgtgaatctcatgcagcatgggtcaggcagggcccagtctagaggaaacctctaggtgtgccagggaagaaaggctctattctcctacacccaggccatcacactgaaggctgtcctgtgattccacatctcctcccaggtcagcaggactgaagactcacagggacaaagctctgaaagcagacccctcccttcacgctgcagtcaccatgtgattcctgcacacttacacacatgtacatgaggcaatctggacttttttgcttttgcagttctaagctctcccctgtatctgtccctgtcagtttaatccacaacaaaaaaaattaactagtgggaagccactacctgtgaattcactgatttgggcaagtgtatttcacccattatgaatcagcttacttagtctcttagcagcctcgagagcttcatttgcagtgtctgctacaaagaatctttgaactctcactccgttgtcagacatcagtttcttgctctggtattcctgcaggttcagccatcttctggaggttaattgaactgcctacagaaattgaaggagagaggtaagaacattcattaatagcaagaaaaataaaagtcaacctacatggccagtcttagaggtactgttgactggcaatctgcaacccagagttgagagaagcaaaagaaaaaaaaaacccacttaaattcatgcctaattattttttaacaaaaactgttaaggacaactacacacacacaaatgaatgcaggttttttaaaaatgctgaaagctgagtgagctctgtgatctagttaacagtaatacacaaatatcaatgtcttgcttttgatattgtaccacaactacatgaggtgtcagcattaggggaagctggatgaagagtacatggggctgctatactatttttgcaacttcctttgagtctacaagtatttcaacataagttattttaaaaactgttaaggactctattacatggatatggctccccccttctcaccccaaataaataaagagcatagcattattttaataactgtatatagactgttaatcattgtaaggtttttcaggaaatttgtttaaacactctgaagtcactgggccacagactaattcatttctttaccacagtttttaacagagtctgggtagggccattgtgtgtttaacgagattatctctttcatccaccaaggttgagtgcaataacctgaaagactgactattaattaaactagttcctaaactgcaacttgtgtattaaaggaaatttgcttaagtttcaagtagaagtggttttccaatatgcactacgtgtttatctgtgttaaaaggacacagtcaaaggacacaataacatgaacaaataaattccttacattttatccaataatatcaacagtattccctaccaaatctgtaagccccatttttaaaagaaggaaaaaaaaaaaaaaccaggaaaaatgaatacacttaatgtaaactcctttccatccatgagtcatatgcaaaggaaacattactcacaagaggaaggatgacaatacagttaatgcacaaaccaaaaaaatcaatcacacaactggatcacaagactggtagtacatggacatcatctgatacaatccctactggcttctgtccacggctttggtggatgtccaaggcagtgtcacacagatcataaaagtgaggcccacagggcttcatcacatggagccattaccttttgggacatctactgtgtccttaaaatgtcattttcttctggtatccccaagctatgatgtattcatggagctcttttgaaatagggtgattcaaagctctatacccccactactagactgtgttccactaaagggtagaaagtgtgccttaaacttctctgtatctctgtgaagaaggtgacagtgcttgacatatgaaagacacccaaaaaatgccacttggatggccaaatgaatcaactctgccttttgtctcctgatatggacaatttttcattcccagaaactggccacctctaaaaataaaaaagtacaagttagtccttaagatgtgaaataaacataatataatgtatacatgctggtaaaaaattcaaatttcaacatgatcaagcctaaagatagctctctgttccgtccttgtagctgctggtaatgatggtttggttttgcttttaatattgaagttgcctatacttcttctttagaaataaataatactgggataaaaataaattgtcagacaagcaatgctcacatcatttaccgtatattattttttaactacacattatttcttaatcttactttttaagtcttgatgaaacattagtaatttgaaaaacacaaaattctgtaaatgaacatactcaaaggctttatagtcttaatagcgtgttatataacatacaaagaaaaatacgagtttaaggcatttagcgaaaaagccccttagtgaaagaaaacattaaacattagctgtgtgctattatctaggaccactcttaaaaggcaaataggaacaatcaatagattatgtctacgttgacataacaatttaaagccattaaccaaagaaagaaaaaatatagtttgaaaagagcatttgagggagactaaaaacagccacaatgtggttgtggtcaattccttttcatcagaacactcgccatattaattttagatatgttaatgcaatctgctggaaactaattgcaattgatccagaggccagcttcacagacatgtaacatatattgactgtttccacactgactcaaatgaaagccagcttgaagtctgttgctcttaaattgaaaaccaggacaatgagcacagttccaaatccactgatgacacccggctatcactccacaaaggaattcttttacagaataatcacctatttttgtcaatccaaaacttggaaaactagggccctgactggctctaaaacttcaagacaactccacttattaagaatttgtagctgggtgtgggcaggcgcagtggttcacacctgtaatcccaacatcttgagaggcggaggcaggaggattgcttgagcccagtagttcaagactagcctgggcaacatagtgagaccctgcctctacagaaagtgaaaacattagctggatgtggtagtgcatgcccacagtaccagctaattgggtggctgaggctggaggacaacttgagcctggaaggctgaggctgcagtgagctatgattgtgccactgcactccagcttgggtgccagagtgagactcagtctcaaaaaacaaaaaaaaatgtgatacatctacagaagtataatttatgtttacttctgcattctcagttgtaaaaaaagggtgagaagaaatctgctatgcaaatggatggtagaaagtacgctggaaatgtaatataaactgctgaataataataacaataatagttccatctactattaattgagcacttatgagctaggcattatattaaatattcatgtttcatggttaaaacaatcaggaaatgtcaagaattattatctctctctgtagctgtcattagtgcaaatcaagaaatatcctcggtcttcttccttctaggcacttccttacttcagctgaagttaggcgatgccgtatctactacctagagttagcaccagatcccccaggttagaggctcagtcccacaggactatacccacttgagatgccaggcacaagccccaggttattttacctgtgcttctgaccaaccagttatcaattgggagttcccaagacctcctcctcgggtttaactaattttataagatggctaacagagctcacaaaaaccactgctgacatttaccagttatttataaaggatatgacaaaagacactggtgaacagccagatggaagaggtgtacataacaaggtatgcccatggagcttccatgccctctctgggggtaccaccttgcagataccgccacatatttggcaatctggacactctccaaaccttgtcctcttaagattttattattttattacataggcatgattgttacctcattagccattggcgattaactcaacttttagtcccgctctcttccccagagactgggaggatggaaccgaaagtcccaaccctctaattatgctatgggctttctagtaaccagtcacaatcctgaagctacctagtggactccaaccactagtcatctcattagggtagaaaagacactcatcacttcagatatcccaagggtcttaggaactgtgtgccaggaaccaggggtaaagaccaaatatgtattttttttattatatcacagtatcatatcaattaactagttccagccagtaagttgtgagtacatatgttgtgtgacacattcaggccaacgtttaattgccatccctcctaccccatcgaagtttgccctctctagatatggggaatggcaacattcaagatggtagctgatctatcagccagggaccagaataaggatggacatataccaagtgactttacgtaaatgtgtagtaaaaaatacacctttgtggattcttagccactgaaattctgggggttatttgttactattgcacaacctttttgcccaattggctttactgaccaataaagccatgttacaaattaggaaacgggctgaacttgcccaagatcacaagttactctgaaacagtaaaacttctggatcaactgggtaacactattggttccctgtgtttgtattctggtcccagaggctctgtggtgatagagactgagataagagacaagtaaaatagtgtccctttcgtcaaaagtctaccaggaataggactttcacgaaatgctgacagagctcgtgtaaggtaaaatgtaactactccaggctttgggagggagggaggtggagatgtgaataggtgttgtcctaagatgctagaatggtagaagtttatttcaactcctaggaagagctacctgttatgaccctaaaaataacatctttgctgcaggagacatgaagaatctctcagataatccatgaattctagaatgcaaggaatggaatggagtataaagatcatctgccccagtgccttttgattgtttctgccagtcatttgccagcctgccctcaggaccattccacaggctcttctgcctaaatttgagactctgttcagagactgaacagtagggggaagacaccaggctttgttgtcctctttgtgggtgtaacagcatctcctctgaagctccaggtctctccagacagccctctcttccacattccagctcctgctatctcccctgctgtgacttctgcttgtaacagctagccctagactcggccaacaccatttccttcctctcctatggctcacggaagattcctgctgttgtccatccatctctgtgttgcctcccaagcctgtgtgccttacaatctttccggccctttgttaaattctattaaatgacctcacaaaatccctgtcttcctgactggcccttactgacacagtgcttcacaggctgaaggtgaaggggaatggcagtgatccacttttaaaaaggtctttgggaccctatactggagaagtttcccagttagtcacatgtttcaaatactggggtttcaagatataaagggaccactggggtccaatcacctcagtttacagtcaggaacctggaggcctgatgagggaaagtgtcttgcctagggatcatatagtaagccagaggcctgatgaaagctggactaattcccagcttttttccttccttcacatggattttggcaaagtgaccgtgataggaacagcatcacattcttaaactagctggggtaggtgggcacctaggttttgttccctttggacttgtacaatatccttgccatcattcccttccttcctgcgtttctttgatagagcaaacatttctaagcttggaggggaaggggaaaaatacaacttaaaagaaaagcaacacataaagatttaagggcctatgggaacaagggagcagaagcagaagaaaaagaatgaaaaatgaggcaggggacaaagagaaccagaagataacaagacaatggctaagtgggcaaaaactgacataaaaactccaagcacaaaaccagacagctacacagaaaaaaaaaaatgacatgcccaagaaatcatccttcgccccatggttttaaaattagaggtgtagaaacaactgaaatagcacctggggtggggaggtgggggaatcaacagagaatatcaaaagaaatgtccctgagctcgacacccctgaaagggaaaatcgtctacccactggctctgcacttgctccagccttcttcagctcgactttgcacactagtactgctcacttgggaaggcagcataaagcagtattagaaagagcccaggacttactagtaatcaagaaaatagaaactcaaacaaaacggaagaagccattttgccaaaaggaatgaagatgccactgaacacaaacacaaacacaaacacacacacacacacacacacacacacacgagatctgatgctattgttgttgaaggtcaggtgaaatgcactttctcagatactatccttacaacagaacactagtgcaaccaccttccaaaacaatttgacagtgtttatgaaaactaaagcacccccattctctgacctggaaagtctacttcctgggtatctatcctagcaaaacatgtaccagagatacatgcaaggatcttctctggagaattgtacataacaaaaggatacgattggaaatgatccaaatgcccatcaaatagaagactggcaaaacaaactataatatattctgactgtgtgaactatttaacattatctatggcaacacagtatcaccaagtaaccatgtgtacccctacatttctcagttctcttgtagctagtatgccaaaacttttaagagaccatgtgcaaccctccagagccctatttgttggctacaaggacctggaagccacatgtggagatggtggaatcacaggtgagattaggctggattataagagttacaacatgggggatgtcacctgacccacatgtgcatgactgagaaataaacgtttgacgtgttaaccactgagatcttaggaataactcatgataacagcattgactaatctagcctattaagtctgaacatggtagcactaattattctacaaggcacaagactaaaagaaaccagcaagctgcagaacaatacatacagcagaagaacatatattagacacacatgttcacacatgaagcaataatgtgtatcttctaaggacagatacatgcataagtaaatgtataggaaaaggtccagatgatgttcaccaagctattgccagtaaacttgggaagggcagaccaagaaatttcaacctaatctataatttaaaaaaatttttttaataatgaatttttaaataaattcatttattatttgtgccataaatatcaatctacttaaaagcaacattgagaaaaagaaataaaagccaggctttaacacaatggtgtagccttaagtctctattaacttttgtgcaaaacaaagggcttgccccttacttaaatgtagcagggttcttcaaatgtggtatgaaatcgaggtgggtgagcaaaagccgcattttctgttatacagaactaccacctctaatataaactcctgctgttagatatgaagaggctcttaaacctcacttcgagctctcaacagcagtgacgacagtggaatacaaacaaggaattagatttaaactcagaggaaaatatatttccctctcattacaggcatggcaatgaaggcagatgcttggtgggctgtggcaagtcaaaagttagtatgtgtttgttatattttagttttgccaatgttgttctgtatgcaaattagcaccgataaatctaccttagtcacgttacctaggaaatatgaggcctcaaataaatgtgttggtgcaaatgaaaagacagatataactcaatgtgtctcaatataagtgtcataaaataaaaggcctgcttgtttaaaacaggctctgatgaagaaggcactttaactgtgccatccggtaaaagagattaagtggaatcctgtttgtgagaggaaaaataataataccaataatgctgttctgcttaggccttaatacgatgacaacagcacgtcaacttctctttcagcatgaaaacatgctacagaaataggtaagaaaagtaatcatcgggattagaagcctaagcctatggaaaggaaaaaaataataatgtcagatgtagaaggaagaataggactgtgggtactgacactgttctttttccctccatgttcaggctaaagagtagtcttcattggaagtcacctttgaaaacagaacgtcacttttgtttagcactgcaatactcttcaccactctccacttgggttctccctgttttgcacactgtaagaaaatgaattaaccaattaattagccccctgtggctgagttcttaaactctagaaggggtacagagagatcctacctaccctatggatggcagaaatggcagctgacatgagtttcacttcctcatttataaaatagaggatactaacaggcccatcttcaaaggctgttgtaaagattaaatgagttaatatatgcaaataaactggaacagtgcccatgacaagtactcaaaaaaagttagctattattatttaatccagaaatataaaagaggaggaaaggtgtaacaagtagatacctggcaatcattaagataaaaatagtaggtgatcatataaataattttgttttaatagtgcccactgagccctgctcattgttttaaatacatttgtagagatatttttaaactctaatcatggaatttctatacttgaatcactcaacaatcacagaaaaagaacagtaatttgcaaaaggaagaactagaaaaatctcacattcagaaagcatcttaaaatgtgctacttagggccaggcgcagtggctcacacctgtaatacaagcattttgggaggccaaggtgggtagatcacaaggtcaagagattgagaccatcctggccaacatggtgaaagcccgtctctactaagaatacaaaaattagctgggtgtggtggtgcgtgcctgtagtcccagctacagggaggcggggacaggaaaattgcttgaaccccagaggcggaggttgcagtgagccgagatctcgccattgcactccagcctggcaacagaacaaaactctgtctcaaaaagaaaaaatgtgctacttactataagtaaatttacttttcatctcatttgaactaggttatccccatctcacagaagaagtctgaaggtgagacaggttggttaagtagcttgtctaaggccactcagctgattaagagagagtcacgatttgaatccaggtccccctgcctaaaaaaaacccatgagctttctattatcacatctgactttttctctttttagtcagtctgtaaatcctgtgtcaattaaaaactacttggaaccaccacagacaaaaactatactgccattcctgacctaaaattactgttttccattttaaagtatgaacaaataaagcagctgacaaattggtaataataataatgacgatatggtacctgaaaagccagcgttgaagggatgtaaaacttaattagagtggatagctagagaagaaaagtactttaaagttcccgcatcaagagaaacaacacttgagttattcttcacaggacatcagactaggatcagaccagcgtccgagaccatttttgttccattgacaacgcatctctgatagtgccacatgtcttatctaaggcctctagcagtaaagcaagcagcatcagtttaaaataataataataaaatcatctgtacttccaaaaaagaattgacagttgagctttcagattatccagaaactggatcacagcaggttgctattttagaattcattcttcttggggtgccttggcaaagtcttacgttgctgatccaaatcaaatactagtgaacatttctgagtcccatgaaattccagaaactgtgttattccacttggaaagcattacctcgtgagattctccaattaaaggaagataccagcagaagctcattttacagataagcaaaagaaggttcagagtaactaagtgcctgctcagggtgacacagctggttggaggcaaagccatatttcaaatacaggtatgtctgactgaggagcctgtgccctttaactaggcagtgctggtgtattatctcccagtgcacaaccatgggccctgagccttgaagtcaactggggcaaaagaagcaggaggctctggtttatagatttcactgcaggaaggtacagagctgtaccgaatatgaggttcactgggaaaatgggaaggtgtgaaagagaggttgctggatcggtttccctaactcgaaagaattaagattcgcaaagatactgccttgttctttttatcctaggttcagcagaaaagcagcatatattttaaggagcaaagaaatgtaaaacactttgtagtaatgacaaatgcccaaaggagagtttgctgcataactctataatgctgctctgccagcagcaagaaagaaaagggagggaaaaaaatacaaccttgataaacattagcatattagcacaacagcagaaacaaatgtataaaaggctctaaaaataccaaacatcctttcagaatgcctgtctgttccctcctggagagtatgctagctcaatcatgttgtagaagaaaatcaccttaattttaccctgcaaacagaagtaggcaagatttatttatagataaagaaaacaaattaaggtaatataaacatatactggcatttaactcctaccaaggaaactggcagacctatactttgttcattcatttaacaattttccactgcatccataatgtggtcactgtgtttgacatccaagatctagcagtaatcagcacagacaagttctttgtggtcagcaagcttttgccctaggaggagaggcagggaagaaagacatgaacacattaatgaagagtgtaattacagagcagcaaatgctatgagggaaaagaaagacacacatgatgaggccgggtgcagtggctcacacccgttaaccccagcactttcggaagccaaggcagatggatcacctgaggtcaggagttcaagaccagcatggcccacatggtgaaaccttgtctctactaaaaatacaaaaattagctgggcgtggtggcacgcacctttaatcccaggtactcaggaggctgagacaggagaacagcttgaacgcaggaggcagaggttgcagtgaaacgagaatgcaccattggactccagcctgggtgacacagtgagactccatctcaaaaaaaaaaaaaaaaaaagaaagaaaaaagaaaaagaaaagaaagacacatgatgagctgtgcaggccaattttagactgagtggtcacctttaaagaaatgacatctgtgcagaaatctggagacagaaaagaggtatacctgtgaaggaactgaggcaaagcacagcaggctgagaggccagcatgttccaaggctctggggtaggaaaggggttggcacgtgcacgaacaagggagtatggtgacagaggagcatgaaaatgccagcagggaccagataatgcaggtgctggtaaggcaaatacagagtttagacttcattcactcagttttaaacagggaagtgagaagatcaaattcacgttttagaaaagccactgttttctgtttggagaataaaaccaattgggagagagctgcattaaaccagattaaggttagcaaactttttctataaagagccagatagtaaatattataggctttgaggccaggtggactctgttgcaactactcaactctgcctttgtagtgcaaactagccatcaatcataaataaattaataggcatggctgtgttccaataaagctttatttggctagcaggccagtgtgctgatctctcaactagactatagagaagggcagtagaggtggggacagaaagaaatgaggggattctggataaagtttggtgatgaggtaaagcttacttgtggattagatgtgggtttaaggaaaaaaaaaagaaatctagtattagacacacacacactttacaatgttagttgatatgcatgtggtaaatctgatgtacctgctagtcataaaaaaggcacttctttaaaaacaatcttaacctcaaatcttttgcccaaactggccttatagtttgaatgtttcttccctccaaaagtcatatggcacttaatctccaatgtggcagtattgagaggtgggatctataacaggtaattgggttctgagagctttgccctcatgaatggaccaatccattcaaggatgaatggattaatgggttaatggattatcatgggagtgaaatcggtggctttctaagaaaaagaagagagatgagagctagtactctcagccccttcaccatgcatcccttggggactatgcagaagaggtctcatcagcaagaaggccctcaccagatacagccctttgaccttggactcctcaggctccataactataagaaataaattccttttctttataaatgacctagtttcaggctgtctcttataagcaacagaaaatgaactaagacatggcctatgtattacatttaattattgacatttctgcacatcattccaccacatcagagctgctgggcctttgatcttataactttcttccattatttaatatcaatctcagcgggcaacaggctacagtacctctatctgctacagtggcccatctgagattctctcctaggagagaacacaaggcctcccttgattacagagatgctacatagaaataacaaaaaccaaagacattaaagctaaggattaataagattggcctatccaatggaatactgtaaaatggttccaatgaatgaaccagctcttgaaatatgtcaatgcaaatatatttacaaagcaaaacacaggggaaaaactagcaagtggtagaacaagaggaacacataagagtatgcacacttaaatagaaaataataatagtaaacaatcttaggaagatacatacatagatatatcaaaaccatttggaaggtgacatgccaagtttaggacactgactatgttaaagggtcagaagggatcatggattttccgatgagacaacaacagacttcgatttcatcacttatactttacgtcttttattttaaagtgatctgagcaaatctgagaaaatagtagttggaacttcttcacattggacccacagatgactgtgatattaatctctatacgctgttttatcctgaataaaagttatctatttcatgtagttaatttaataactacatttaattccccaaagatgggtttattaataaaatgaaagaaggcaagctagaaaaagaaaaaaaatctaattacatttaataaaattaataattttctaactactttgaaaagattaataagatctgaaggaaacctgagattatgacaggccaaaagtccatgtgacacatgagtaactgaggcctgaagttacaagagtaacggacactccctcaacaggccagcattaagcacccatccctgtgcttaggcactgcccttgcagcctgccaagacaacatctctgcagaacaggtgagctcatggaagaaggcgaggatatttgtgccaagtagcttggtcttatgtcaggttcatgttcataaaaattgagtctctgctcacttgtggcacaaataactctagaagttgtttcctgaaaattaagtcactgctccatctcatttaaatatatatatatatacctatgtgtatgtatgtgtatatatatgtcattccccccacccactcaggtgagtctctgtggtggcaaaagagggtctgtgttccaagaatcatctccatgcaaagtgttcatttgaaaacaaattgcggctgggcgtggtggctcacgcctgtaatcccagcactttgggaggccaaagcgggtgaatcacgaggtcaggacatcgagaccatactggctaatacagtgaaaccccatctctactaaaaatacaaaaaaattagctgggcgtgatggcgggtgcctgtagtcccagctactcaggaggctgaggcaggagaatggcgcgaacccgagaggcggtgcttgcagtgagtggagatcgagccactgcactccagcctggatgacagagtgagactccatcttaagaaacaaaaaataagaaagaaaagaaaacattaaaaagagtacaatactaggccatgggatcattctttaaattttcaaaaaggggaaaaaatcttgttctggggctattcattattcattaaaacccgcccaactacaccatcagagcagatcctttacaatactcagagaagggaaagtactagatatttttattcaaccatgtggcccaaacacatcaccagtgtgagaggaacaacagcagtgtttttcaagatctctacctcaaatgagcttgcacactaagcgggtaaagcagagatattagcaaaacaccagcttccagggtggctgggataatgtacgtgaaggtgctttgtaaaccctaaagaacctacgtgcacattcaccatcaccattaccaggggtcaaacatgtcatctcaatgcatcagatttgactgtctcacagggccctgctaccatctccacaccctgcagttagcaatttgttagccctccttaaattactccccacagtcctttccaataaatccagatgaaagcttgcaagggacagactttattcaatcaacccactcctgctccttctaaggatctaatagtgcttaatagtttaggatacatttgagtttaatgggatttacctgatagcaagagacttctcatcacttctttatagcggcagttttgagtgacctagctaactcaatctcacaagtttgcctgtcacactggcttgccaaagaaatgacttgtagagtaggaaatgagcgaccttcgctggggaaattcctgagatcatctgacattttgaatgttctctgtgcagaatgataattggtgtctgtgaggtctgaagtccactatttgtgtttagaaagacatttcattcttgttgatgaataaaatactactgctatggaaaacttgatcttagatgcttttaaagaaaaatataacattgcagagagcaccctttctttcacaatttcattgtcaaaatctccatttaaggagaaataataattttgatgattaaattccatggccctccccaatattccacataaaatgccctagttataaaaaagaaaaacacatgccaaatttttccatctatgttagtcatctcttctcttatagtaatttgaatttctttagccagggagggggagagggtaaatcatccaaatattacttttatctataagaataatccatagaagttaaattcaaggtgagctttcagaaaactagatatcatgaaaaggaaactttaaaataatccctgaaaaaaaaatttatacccaagtgcagaatgcacggtagtcaaatgagcctgtcacactgtccaggaaatgtgtgaaatacatactgtcattcatttgaaaagtccactgtgatgacaaagacctcagaaaagtacacacaaaaagactcttacaaatagacaatctgacacagtatctaagcagcaaaggaaacaatatcctaaacatactataccctcttaaaatcagaggagccgaagaacctaagaaacatcaagaaagttttatactaatgactcttcttttaggaacccatagtgaaatgctagatgatattgctacaagctaacaactggcccaaactagaagtgaagagagaatgaggcagaaaggatcaaagtatgctgtaatgtcaagatgacagttctgggagttgataattgagaaataagcttaagtgagtggcatcgaaggctcggtgggtcatcttcaccctgccatttattcacaggtgacctctgtttgtttatgctaactgcaaatatcaaccaccatgaccttacaagtttgctggcaaagtaaaatgaaagatttctgtgaaatctcttttccacctcgtccaggatcaagaagcaacaccagggaggtgagaaatgcaccacagtggggatttggttctatgaccttccaccaggtagatccagccagcatctaattagctacccaatgcaggagaaagatctaaacaactctcccttattggccattactctcttctcttgaggacctttgcctctaaaggaggacagtcagctcaaaattaaaattgatctctgaagctcctgctgcctctgaaaacactagacatgaaagctactcaccttctcagggcagaagaaacaccccaaggaagtataccgatggccgggaaaatgaactgaggccttgagaacaagccccctcccaaaagcaatctgctgaacaccaagtatcacctacactacacggtaagatctagtgctaagcacagtggggacacagaaaggatgaatgtaagactggaccaagctgtctaaaccaagctgctatattcatagcagcactaggggaaaaaaattaatggagtgcccctggtagaggagaatggtaagcagataagaactagattgaagtaggatcccacagtcaaaagagcataggacagggttgtacccaaagtaggagtagctacatatatatatatttacattttttttttttttgagatgagtctcgctctgtcgcccaggctggagtgcagtggcgccatctcagctcactgcaagctccgcctcccgggttcacgccattctcctgcctcagcctcccgagtagctgggagtaatttttgtatttttactagagacggggtttcaccgtgttagccaggatggtcttgatctcctgacctcgtgatctgcccacttcagcctctcaaagtgctgggattacaggcgtgagccactgcacccggccactagggttatcttttgtctgaaggctgggcacccatggagcagagcgggggctcgggcaaccatcaaaatgatcagcaccaagcagcaaggggtatgctggacaaaaacagcaattgtagggtacacgggcccaagagatgaaatagtgcctcaggggactactaacaggaaaagaccagttactggcagtcactggtgacaggatggtctagggcacaagagcaagaatgatgaaacaacacagaccaacatcatgaaagagaaacaaatagaagaactaacgctgaaggagaaaaagttgaaggaggacatagcacaaaactgctttttaaaagtacatgccgggtgcagttgctcacgcctgtaatcccagcactttgggaggccaaagcgggtgaatcacgaggtcaggacatcgaggccatcctggctaacacggtgaaaccccatctctactaaaaatacaaaaaattagctgggcgtggtggcgggcacctgtagtcccagctacatgggaggctgaggcagaagaatggcgtgaaccccggaggcggagcttgcagtgagccgagatcgcaccactgcactccagcctgggcgacagagtgagactccgtctcaaaaaaaaaaaaaaaaaaaaaaagcataatacatcagacagacgtgagaggacagtatatgtatcaaaaaattttcaactagaagtttgaaatgtttttgtttttaaaaaaggactagagatgggttgaaagtagagagactataaccagaagacaaatcagtgagcttgaaattgaagatggggggatttcatggtcaaatatctgggaaatacagttttattttcttcacttagaggttctcgatatatgctttatttgaggttctgaggagcttgaccattaaaaaaaaaaatctacttaactatatttagttatcccccaaccaatttttacttggcatctgctttaaatcccatggaattagttactcctttgggaaatgccatagactgcaaaacaggacaaagtacacaactaaccatacaccatatagaagcaaattggagctgttgcacatctgtgtgaaaatacttttacttggatatttcacaattattttctcattagatctgaacagcatctttgggattcaatgtagtaaatcaaaagaaagatgaagaggacctagacttgggccattatcagtgacgtgccagttatgaagttattttgtctcagctccaaaatctcctttctaggtgttcattgctctgcggggctgataatcctgcaaattactttctctttcgccatctggcttcctattagggtctgcccatatggggcacactatagggagactaaagggctggcagatagagatgatatctgctcctttctaatgttttgtcaccatagcccctggccccacagctcctcatcctggcaaaaggagctggtttcaagactagctggttccagtttacaggtgctaccagcactccctgaccagccttggagccactgaaaccagccaagcagcagcctttccgaaaactctagatcccagctctgcaggacctatgttccaagttcccaagttcttagagagcttcaacctcttccttttatcttgggttgggggtgggggacactgcctcctgcaagttataatctctgttttagttagtggtggttttttttggagttttttgcccttctagtcctccaatacttctttactcaattctctatgttaaattttatctgttaaaataatgggcatagtctctatctttctaactggaccccaaatgataaaagcaggaataggaagacatatataaatacatagaaatttagtaaatacttccctgtttcatactttcttatgtgtactaattttatatatgtatatggctagagcagctccacagggcaatcacttgttttgttcactgatgagtgccccgtgcccagaacactgcatgagacattgtaggcattcgatttagttttttattgaatgaaggcgagtatgaatgtataagatggtcaaaggtagatttacccctatatgcaattgtaaggaatattttgatacactatttgggatgagtggatgagacacccagagggtatgtttaagtaaccacagatagaaagcaaacttccatcgaagagaagggtgtctagctgaccacaggactttttggtgagtggacatggaactgatatggtttggctctgtccccactcaaatctcacctagaactgtagcctccataattaccaatgggaggtaactgaatcatgggggtgggtttttcccatgctgttttcatgatagtaagtctcatgagatctgatggttttataaaggagagttccctgcacatgctgtcttgcctgccaccctgtaaaatgtgctttgcttctcctttgccttccaccatgattgtgaggcctccccagccatgtggaactgtgagtccactaaacctctttcctttataaattacccagtctcggatatctctttatttgcagtgtgaaaatgaactaatacagcaagttgggaattatatatagcaagaactgctccatgttaacacaggagaacgttatcagtgagcagcgggaaaaggcagacaggggaagagaacaaggaagaacagacacatgtgatgagaatgcgtgagaaaagatgttgtggattcagcatgccttcacatttcttctctgaaacctgcagcataatctgttcggtacgctttggtgtaagaacgttttctgctgaatatgaagagaggctgagcaccatattgagttaagcactggcaaagacagatgtcatgtgtggtgttttctgacaccaaatatgtgttatttcctcagaattctccaattatccaacaccaactggttgtccaaaaattccattcaattctcacactaactcccagagttagcacaaacaccacaggttaagggctcagtcccccagactgctcccactccagatgccagctgcaaacagggtggcaggccacctgcacacacaggggttcccactgctcaggttcaataagtcactagaacaactcacagaactctagagaatatttatgattactggtttattataaaggataaacctcagaaatggccaaatggaagagatgcaatagaacatgatatgggggaggggggggcgcccatatgtgttcaccaacctggaagctcccctaatgtcagtgtttcagagtttaatcaaggtttcattacttagccatgattaagaaattggccattcgtgactgaactcaatctccagcctctctcccctacttagaggtgttggggtaggggactgaaaactaaaagtcctatccacccttcttggcatggctaacccctcccttaaaactatttaaagggccaccagcagtcacctcattagcataaaaacccaggtatggctgaaaggagcttaaaaataacaaaagaacattttataagtaacaaaagaagctcctaccactcagggttttagatatgtgccaggaaccaggaaccatgaccaaatatatatatattcattataccacacattacatgctaggaaaatcagctttcattacagcattctctaatcctactctctgcccccttctcatcttgcaaccctaaaaacacaaaagataaattatgtggtacagccaggaaatgcatattgagcttataaaaggattcttatgctgtctctaaaaataaaaaaaaacttttcagagaaatgtattatgaggatacaaggtactgtacactctatttacgataaaggaatgaaacctactttataaagcaaatgtgaaaaaaaaaactccttaattacctatcttacatatttcaaaataaatgttaaacaaattctaattgcattatgttgtttaatattacctataagaaatgtaaaggccttaagcacaaacaaggacacaaggaaagaaaatcatttaaactgtagactttggtggttctattatatagaagattaaatactgatggtcaaggacattaaacatagaatgcaatgaatttcctttctttcgaaaacaactggaataaaaagatgttgccattaacgctataagcatttagtaagtacttatgtgtaggataaatgatttaaatatggttttgtgggaaggcatcaagataaatgtccattcatttgataaacccttttaaaactaacaattgtgccaagcaccttatgtataaagatagatggcaaaatccttgctcgcaaggcactcctagtcgcaaggattaaagatgcccagcacttgtaccaaccagtgctcccacaagctgaacctatgaccgacatcactagtcaatcgtctccttttcccaaaagaatgacctcagcctcacaatcctcattacacagtgttccacatggataccatcaacaggagttgaaatacaaggtgaacctacttgcctagaatactaaactttaatcaactgtcctgaactaacatacgatacaaagccctgcatcagcaagttttactgtaatgcagccatgcctgcccctttatgtactgtctattgctgcttttgcttttgagtagtctcatgcaaaacctaaagtatctactccccgatcctttaagaaaaagtttgcagaccaatgtcctatgaagaagaccaatgtcctataagaagatgcagataaacttcttgagagtccagatgaggaaattgcaggctgatgctctcttacaacagcactgagagtcccacaggagatcctcactagctacttgacagcattcagcagcctcccagtgcaggtatgtgaagacatttgctttactaagcaaatgataaggctctctgactctcatcagaatctccctgctagtcgtcctcactggcctagaccacaggaaaagatgaccctcttgttacctgcagtgatagaggtgaatggttgcagcagggaatgtaaggcccaggagtataaagtatttactatggccgggtgtgagggctcatacctgtactctcagcactttaggaggccgaggtgggtggattccttgaggccaggagtttgagaccagccttgccaacatggtgaaaccccgtctctaccaaaaatacaaaaagtagccgggcgtggtggatacgcctgtaatcccagctactcgggaggctgaggcataggaatcgtttgaacctgggaggcagaggctgcagtgagctgagatcacaccactacactccagcctaggcaacagagtgagactccgtttcaaaaaaaataaaaaaataaagtatttactacgtggtcatctacagaaaaagtttactgacctctcattttacctcataacacctctcaatgtgtaattatacatgtgggtgatttgtcagtgtctgccacgtcccatgagactatgatggtctcaaaggcacaaaccatgtctcatgcattcaccaatgcatttcccatgcctgggacagacctggtgcttctttagtatttgttgaatgataattaattaattagatacaaagcccaaggacacaatgaccctcgatctaaaactggggccactgacttgccttcatagcagacaaataataatggttcctgtgacaacaaattattagacaaggtcaggcacttcccagggctaacagttcagtaatcgtgtttccagaataatacagatttcagcccatatgcccatcatcatttatctctaagacttcaaagctaaaaagtttctctctgcattgagccatatattatgtacaaataaatagacaaataagccagttcaagcacaaattctacagggaaaatccagagttcatttttttttagacacagtttcactctgtcgcctagactggagtgcactggtgcgatctctgctcactgtagcctccccttcttgggttcaagcaattctcgtgtctcagtctcccaagtagctgggactacaggcacgcaccaccacacccagctaatttttgtatttttagtagaagcggggtttcatcatgttggccagactggtcttgaatgggtgacctcgagtgatctgcccgccttgccctcccaaagtactgagattaaagatgtgagccacagtgcctggcccaaagctcattttttaatgagcatctactatgtgtcaggtggcatgcttgagcaccagtgatgctcaagcatacagtgatgtggttaagatcatggacactggatcacggacttgtttgagccctggccccactatgataatgaccacaaccacttattaataatacaagctgaccagggaatggggcactgtttcagcgtattgcttttgaaatcataaggtaggtaaagggtgatctccaattgcagatggaaaacggaggcacagaaagattaacacatgtttccaaggtcacaaggatacaaacctaacttctagagtctatgaccttaatcactttgctgccaggttatcatgtgtaatcaatgagatcctgcttttgaggatacattacagtacctaacacaaagtacacactcaacaaatgctttcattataactatcacatcaccataatcatctacactgtcaagcaaagaactcatttgatctttcacagatttagctaacatgtacaaagatattttataatccttcatattgagatataaatctgagcttgtccaacggtgcttttcaccattctcatcgctagaatccacaagtgtaggaggatgaaggtacaggtagtgcattttttaattaatgtgcttaagccagaaaacaaaatcaagaacaaattaataacgaaaagtaaaatgtttttaaggttattcaaaaggacatgattatttttttgggctgttttgcagactgtctcaagtaaaatttctctaattttatgctagatgaagtacttactagcaaaatgtatccattaaatatttattatatcaatattcataaacaatgtagtacactgcaatcagtttctgtagtaaagtcatttacacagaggtcaaacctttcaaatacagaaaaagcaaaccaaggtctgcatgttttcaaacaccaagttctaaaccaaaagtcagagttattataccctgactccttcattctgtatttgatttcttcatgttctatagcctataaaataatgtaacaggcataattacagtgatttgctccccaggtttggatgaaattaaataaaaattccataatgaaatgccaggaaaatacctagttgtagtaaatgccagttaaagaacaatgcttcctgtcaatgtctatgttcaataagtttacctggcaataataaaacaaaactttgttaggcagaaacattttaatggacagttatttaatgcacgctgtgggctatgaagggccctcagaggaaaagccatgtcaatgtgggtctcgctcagtgtggttcctttccttcaaggatggaatcctctccgctttctgcctacttttagttacactccaagactttaaaatattttaatatttttaaaatatttcttatattttatatattttgtccacaagttatcactgttttatctgttatctgttaatccagtataagactactccattcctggaataaagtattcattttataaccatggtgttcagaaaactaaaattttcagatgtggttgaatacagaacagagctgaaacatcatgtccccactgtagacaccctccatatattatctaagcctaatgctacaacttcctttcgtatccacatgatcctgcatcgtctagcttcttcatagccagtatattgcagtgctcagtgtcttgtaaaaagctctttggtgccacaacaggcagggaattctctttcctttgctaactcttcaccaggaccactaccatcaccaaggttactatcaagagtctgtaggactcttcagctgggcacagtggctcacacctataatcccagcactttgggaggccgaggcaggaggattgcttgagcaagacccactctcaatttgtaaaattatattaaaatttaaaaaaaatttttttaagagtatatgcttcttttggagcagatttcaagaattctggtgcaaacaaagtcaactattagttatcttataaagtttattttcatcatttcattctaattaactatacttaataatttgctcctcaatatgaatgaaaatttcagcagtattctagctacaagagtcagtaaaccattgcctacagaatctaactcatctggataagcaaactactcagtcactatttatctctttaactaaaggttcattcaatctttgggctctcattagtatttcttagtcttttccctgccaagttcatgccagtaaacttgacagggcacagtatcatgaaaatggtatttttcatatttatcttcctcaggaatctgctgaaactcagtgcagacaatacctgtcttccaattctaaccacatgtttgagaatgtgcacgtgtgtatatgtcatactaaccaatcttccttttcctattagttcctggctttactacttaatagctgtgcattcaaccactctgtgcctttaatcctcaactgtaaaacaagaataataaacaggattgctaggagaataggatgagtaaagtgcttagggcatctgtcacgtaaggagagctcagaaaatatcagctattctcatctattatactatgatttttgcgatattcaacactgcttccaacatcatcatgaagagccagcaaaacaacatgaagtgacctaggacattcaaatacatgacgaaaatcttcatgacacaccagtaattgtgcaaaagaggtaggaactgtggcagaaccatcacccttaaaaattcatatcaaattcctgccttggctgaggctttgcactggttatcagtttttcagacctcttgcctgcctttcaaagcccaacaactgtgaactaagcatatgaaactgagacaggcaactgaacagtgggaaaagagaatatttacattgtgtgtatcagacataagtgaaaaaagctgagatcccagtgaagagtgattcatgggtgacacatattcagactcaaactgcaaactctgtctcttgggcagcagctcaagtcttactttagttcttttttactttagctgggccacttacagtcagccttatgcatgtgttgttcatgaaataccttctgatttggtcagtttatacacagaatccaggactcctcctctctgactctctcctttctgagacaccctcccacccccagtttcccgctgcttagggatcctgaactctgtccttcagttctccagtgcaaaaagactacaggttttctaccggagtttagccaccattgcaccctgtcatcaagaccaaaaagctggaagtaaaagctggaagtaaaaactggaaactcaaagcaggccttttgtttcccatttcaactcccctccttccagtttcgactcccctccagggtctcccagcctttggcactttccaaaaccttcaagtacttgttttatattttctccaaagcagatagttactagctatgcaaagcccagtctgttaagagcttacatggtcacacaggaaataggatctgtcaatgacacatattccagagggattcaagctcaagcggagatgttcttttctattccacatagccagggaacactaactcatgaacagggacaatactttgaaagttcatcctattaaatgacaaagagtcttcaccttaggagaggaagtcacttccaagcagaaactccaaagaaatgggtaaagactggccaaagaataagtccaggagcttgtttgggatgaacaaactatgcagacagcctgagagctatgaaaacacacacaaagtatggtaatagaaagggtctagaaaaggagaagattctcattcaaagaggtaggaaaatggacaccaaggcagaatcctttttttttttttttttgagacagagtcttgctctgtcacccagactggagtgcagtggcaggatctcggctcactgcaagctctgcctcccgggttcattccattctcctgcctcagcctcccgagtagctgggactacaggcgcccgccactgcacccggctaattttttgtgtttttagtagagacggggtttcaccgtgttagccaggatggtctcgatctcctgacctcgtgatccacctgcctcggcctcccaaagtgctgggattacaggcgtgagccactgcacccagccacctggctaattttttttctatttttagtagagacggggtttcaccgtgttagccaagatggtcttaatctcctgacctcgtgatctgcccacctcggcctcccaaagttctgagattacaggtgtgagccaccatgcctggctggcagtatcttttttttttttttagaatcagctgataatgtaacttactcagagatcctggtggaggatataaacgttcagacccaaaacagacaacatccagaccagggatggcagagcctcttaactctgaccagctggaaatggctgcccagggagctgtagaaagtaagacctcaaggctttgtcatggtagacatcaataatcactcagaacagcatcatgagtgattattgatgtctacgacaggaagagagaggggcagctcagtctcaggtattcacaagccagaatcaagtataaggttataggacttgagaagaataaggacagatttgtcaacatcatcattattaagattactgagtttcttcaatatgcccagatgatgtttagagtaattcaaatttaagtgaaattaaaaagggatatcagacaggctaaaataaaaaagtgccttgaatcttaataagcccacagtatatgaactgcctctaattagattcaggaatatgactccttttgaaaccaaccaggagaaaacacttattcagaagatttcaataaaaaattaataaccacttgcttccactttatcatgcacagtcctcaacggtggattttaaaaaacgaaagtacagtctgtctcaggaaaattgtacttgtgagtccttcaaaagctaggacattttaatcaataaagtgtgagggcaatttactgacttacataattcaacaaaatacttgctattcaaaatgagtgaagtctgtcactgaaattgttaagggtttatataaatacactactaaattaacaaagaaaaaagcaagcaaaggctgccctccaacctgatcttcatgctccagggaaccagttctttatcaggataatggtggttgacgtttccgtaagttatctggtactctgcctttcttttttggagagagatgacttgcccaaggtaaatccagttcagaaagggagcatccatgccagtaacttttgatccatgtagctttctcctataccacattatgacttgctataagaggacagttaaacaggataattacagagggcaagtttcccaactaaatgacaaccattaaaattagacatgaagttacaaaaaaagagtgaacagagggagattttcttaagtactagtaaatttctacttaggtcctaggaagtgctgtttactttataattacatgttaaactacatatatgataagtattttttcagtattttatgctacattgcacaattttaaaaagctttaaagaagagtgtaagcttctaagtctcacagctgtgaattcaaattcagactctattatttacaagttggatgagtttagacaaacttctcaacctctctaagcttcagtttcctcttgtgtaaaatgaagataaatgatagataatgataatgatagtacctatgttacagattgctgctgagtgtcaaagagaaaatgccattggaatgcctagcacttagtggccctctctggactggtctctccactgcaaaggcccaaaacctgccccctgcattgtttccaagctgatatacatcaacacatttccagattgtagctacacttggcatttcacctcctagttgacagtgtgaagctgttcatactgctatagggcagcacacagctgaatgcaaacacagttcttttgccttacctaggagctccatggatcaggagatgccctacagctgagagacaggcaagtttggtggataaagaaagccagcaagtggacaatcgaacataatttggaattactggtcatcaaagtctaattccagaaataaatcaattcaatggaaagcctttatagcaagcagacagatttagaaaggctgtaaggcacagaagaaatcacgtagacttgggagtctgacaggtgggtgttcaaatcctatcttggtcactaagcagtaacccaattgtagcggatgttgtaagtgactcgccagtatctttttctaaactattcagcagcttagccaataatggagatttccaatttttgccaataactggctcagcaatgagcatatgacctaatccccagcagtgataacctagaggaagtctaatgggaaggttataggaagaacttcctccctcatagaagtttaagaaaataagaaaaaaaaattatctagattaactatctagagctattccgtggccttgtccagctgcaaggcaagctgggagatccagtacagccatgtgtccagagaaaagaagagctggcttcagttaacggataatagttcctggcatgtttttaaagaaagctctgtcaaggctttcttctgtgtaatttattgtaatgtacattcgaaaaaaatgtatatgtatcagtaatttaccaagcccatactttcatggacactattacttatggaggggctcaaatgtggatttaaatatttttaatagtgaatagatttagaagaaaaatgtgaagtcaatgatattgatacttaaacatcacaaaaagccctgaagaggtattaccctagatgaggcaccgaagtgttaaaccagttgtccgaggcacaaagctagtaagtggcttacatgtcacattagccatggaagagccttgcagcagatgctctcagtgctccatccgcatggcctcagatcgcgccaccatttttatacagactcactgtgcactcttactcccaagagcagccccggcaggtctttgtcttaagatgctgaagacaacatgcccttaaagaaccttgaagagggtatataaatacttcaactctcttgcccctaactacaactctgaggtgtaacctacacagtttccatagctgtcctgtggaattaagcaaagtcaccctctttgggattcagtttaataacacacccttctcagcctccttcccttcaacttctctaaacccctttgagtttttcctgagaatgcctccccgaaaagccactttcacatgaatccttttctcaggatgtgtgaccagggaacaataagaaaagtcttggggttactatggtccaaggttccccaaacaagaatcactcatacacaattcttgctacatctagagaacactaataccagtatcagtttatttatgatgtttattttaacttaaagatagagaaaactttagagcactacctatactgtttgtttaagtagaaggagatagcataattaaaaaataaaagggattcaattctgattatttgaggtatgaagtcctaagctgaagatcttaaaagcacacaagcacaaaactgaaaatttctccgtgacaaaatcctaaggttccaaagacagtaacaatgaattcagcactatgtgactcactggtattggatgctgcatccctgcgttacctaaactcatctcgtgtactgccaatggatgtgtcccgtgctctgggcagcactgtttcaacagccattttgcaaagttaagcatgtatctggcacacagcataatccctgatacatgatagatgtacaatgaatgttaaacagagtttagtaaggaaactgagtctcttccctaaagccatgctgttgatcagtgggccagaaacaggcacaactgaaccttttctctgcataccatctgcctgcatctagaacagagatgtgattcactcctaaaaatccactacgattcttcctagatgacttcatctacagcagtaaatctacacatttatatagattttttactctcttataacatttgttttccccattctccccaaaactcgttgagcattccatggaatattattgctggctaattttcaccactatttgcctattggcataaccgcacccactttttatcatgctcctttttcaactactgctattactcctttttttctttcattagaaccctcagaagtgatttcacttttatgttcattattgttcatttacaatcagcttttgattgcatgctgattgttcttaaatttcaactttagactgctgaagaaaaacagtgcttggtgttagcttctgattaccaaagatcagctgaattaagttacaaaactgtttttcaaaaggcctggaacataggtagtaaaatgttagtgtttttgtttaaccttgggtgagctgtctggataaagagaatggttaaaaactaagtgagattaaaaataataatgaggtttgctggatttacttaaaatcaaaataaaaaaataccaaaattgatacatctgaacaaggctctgcatttattccaatctcttgctattgtttaaaatatttctagagctcctatttgggaaatgacaataaacctgtgcccctttccttgggatattcttctcaattgcaactcgtctgtctttaagttgatttcactcatagaaatggtcagagcttctcaaatccaacaccagcaaataaggtgtaggaaacaatgttttagttggaaaacaagtgctggaagcataaagcaaaagaactcatggcagtggtccatgggctagctctccaagcagccagaaaagcatgcatctccagcaaaagttcagagactccagaagtgccaaggtgaaaaaacaaaggctcatctggtcacatattaggttggtgcaaagttacaaatttcaaaaaccgcaattacttttgcaccaacctacaatttcagatgtgtttgatcaaaaaaatcaaccacacccacgttgtctcaatgcagggtggttctggaggtctgtgaggtcaaaactattttcataataatactaggatgactttgtcactctcattcttcacaaatgtacagaccacaaaaagttcattgatgtgtgtattagtatcctaggactggcgtacaaagtaccacatactgggtatcctaggactggcatacaaagtaccacatactgggtggctgaaactacagaaaggtattctcttgcagtttaggaggcttaaagtctgagatcaaggtatcagaagggttggtttcttctgagggctgtgagggagaatctggtccatgcctctctcctagcttccagtggttcacaggcaatctttggtgttcttggcttgcaaaagcatcactactttcatcttcacatggctttctccctgggcgtgtgtgcccgagtataaattttctctttttataaagacaccaatcatattgaattagggccctccctaacgacctcattttaacttgatttcctctatctatctcttaccttctatctcctttaaagatagagtctttacagagaaaatcaaattacattaggtcacattctgagatactgaaggttagatttcaacataggaattttgtgggggacacaattccacccattatcaggcataattcagtggacccacgtgagtggcatcctgaggagatgtgcagggcaacagctgtgacaacaaggaagttgtttaagatctctgagccgcagtttgttactctttaaaatgggcttagtagctaggcatggtggctcacacccgtaatctcagcactttaggaggctgaggtgggaggatcacttgaggccacaagttggagaccaacctgggcaacaaagcaagaccttgtctctacaaaatttaaaaaaaaaaaattggccaggcatagtggcatgcacctgtagtcccagctaatctggaggctgagaacagaggattcattgtgcccagaagttcaaggatgcagtgagctgttatacgatcttgccactgcactccagcctggatgacacaacaagaccccatctctacataaataagtaaagaaaataaaatgagcttagcaatggctataataatgccttcctcctagggctgccatgaatactcaacatgataatcctcctcaagtgcacagcaccaaacctggcccacagaatgtgcttgataaacatcaggtgtctatttgtacatgtgcttcatttcaggttatccagacaccattaatagccattgtacaggcaagtccagcagaaaaggactctgtgtgtgtgtgtgttatccagacaccattaatagccattgtacaggcaagtccaacagaaaaggactctgtgtgtgtgtgtgtgtgtgtgtgtgtgtgtgtgagagagatggcaccctgcaagggaatggcatcctggttcctggcaaacaggttcctgccttgctccctgagctactgggatgggcatctgccacctgtgacacggaactggaataaaatgaatgaatgtaaatgattgtcaaataaacattcatcaagtctacaataatcataaaaacacactaaacaacgtggtccaaaagtactcagtgtttgtgtttgtttctgaactttgtggtgaaaggaggtgctccctaccattttcactttgcaaacatttattctgtgacttaaactacaacgactacgaccgccatcactcacttatcaccagaaactgggtaaatcattatcttacttgtttttattaatctttttgaaatgtaagtagagcttacatttaattcactgtttaatattagcggtgtttttggtctttggaagtttgatgatgtttctgtaacctgaagtatgctgaacttaaaactcttgtttacatcaattagcctatagaaaactggtttgctttatggtgaaaccatttctgtcctccaaggctgtataattaacttcttatcctcttcctacattcagtgctggaatgggtatggaagcagagaacaaattggaatgtctttagtgaggacttacagtatccccagagggctggggtgctctcacaacaccaaacacatctcactgtaattgcccatttctcatcagtctccaacaaatgagactgtaggttccttaaaggcagcaactgtctcatatccccaagcttcctacaaacccaccatctgcaacctccgcctcccaggttcaactgattctcctgactcagcctcccaagtagctggaattacaggtgtacaccatcatacctggctaatttttgtatttttagtagagatggagtttcaccatgttggccaggcttgtcttcaactcctgacctcaggtgatccacccacctgggcctcacaaagtgctgggattacaggcgtgagccaccgcctaatagtgggcctaatagtggacctgtgctgcatttgacccactgaaagaatcaatgaatatgaatatacaacagaaacattatcaggaaagatatttcttaatagacattttagttggacatgggaaactgaaaatgtagcccaagctacatatgatacaacatttctactcaggtgaatgttaacataaggtatacctccacggaacactcatgttcatagcagcattattcacatagccaaaaagggaaagcaacccaagtgtccaccgacaaattaatggattaaaaaaaagatatatacacatatcatggaatattattcagcctaataaggaaggaaatttttgcacatgctgcaacacagatgaactttgaagacattatgctaaatgaaataagccagtcataaaagaatagctatagtatgaatctttttagataaggttcctagagtaggcaaattcacagagatcaaaagtagaacagtggttggcagggactaggggaaggggagatgggggagttagcattgaataggtacagagttttagtaggggaggatgaataagttcaggaaatggatgatggtgatggctgcataacaatatgaatatataacaatgtccgagtatggttaaaatggcaaaatgataaaaatggcaaaaatggttaaaatggtcaattttatgtcatgtatattttactacaataataaatatataataaaaattttaaattaaagaatatacacattcatattttttagtatctttagaagctttggaaatcaaaaacaaggtttcagagacaaaaaaggaacttaatgatccaaatttttaatcaaaaaagcaattcttttgccacctccctcaacaccctaaaagtcaatcagaaaacactgctttgtgtcaataattaattttacctaaattatgacaatgttgcttaacatcaaaattccaggaaaaatattccactgacctgaaaagaaggactctgaagtatgcaggaggaaatagattcatcctgtagcacatgacaacacatcttcaagaaaggaacactatgactcttggcttaccataagcgtaacattactgatatactgccaatattaagcaaaatgaaataccactactaaatattctcacttggggccctttaacataaagaaaatttagtatttttctctcatcttcctataaagtttaactctgtaagtctccccacatattaaaattatattttatacaaaatatagtcataaaagctattttatactggtcataaaagcctcatcatatactcatatcaaacaaaaaagaaaggatccattagacactcacaacatgctatgctgtgagttttggacgtgggactccaatcctaaaagcgtcctcaggcccaccctcgcttaggacaagtcacaagccttctgcctccatttccaaccatcctattcaacactcagccattcagtccttctgcatcattttaaaattcatgaggataatctgtttacaacttcaccatctcaaaatttacttagtttttctaatgtgccaaatagcacgtatatttttttccatggtaattataaaaaagttaaaagctgaaaaattccttttttccctgtattgttggctttcaattttaatgatacatcactttaaaagagccctgaatcttaacaaagaaacactcatcattaatagtttattcccttaatcaaaaataattcataactctccactttctattacttattaaaggcccacgtaagccctcaggctggaatgagaatgcctatgagaactggttttccccctttctttcaaaggtaggaaaggacttactaactcaaataagtccttcaagtccagatggtatagcatagcatctcaacaacaggtaagagagtacaagcagaagctggggacaaaaagcaaaggataaaaaatagttccttataaaaatgtgaagagatctccattgataaggagaaaaccttaatattttctggtaaagctataatgctgatccctacttctattcaatgctgtgggcaagccaatcaatgctgtgggcacggggaagggaggggaatggaggggagggcaggggaggggaggggaggagaggggaggggaggggagaatatggtgccctaaatggatcaggccactccccagacactgtacccagagccctgagccctgcttcaggcagggaggaaagcatggtgctgttcctctccacaggcctcccgacttcagccacagacaataagatgggggtggatcccttacttaaaaccagacaatatcgaaacaataaagtttggccgggcacggtggctcacgccttaatcccagcactttgtgaggccaggtgggtggaccacctgaggtcaggagttgaagacaagcctggccaacatggtgaaactccatctctactaaaaatacaaaaattagctaggtgtggtggtgtacacctgtaattccagctacttgggaggctgagtcaggagaatcacttgaacctggaagatggagggtgcagtgagccaagatctcaccactgcactcaagcctgggcaagagagtgagactctgtctgaaaaaatataaataaaaataaataaattcagctttcagagacactgaaatgtgaaaaagaaaaaaaaaaggtatcttacaaagaaatataagtaattgtcacaagatcacaaagctatggagtgctgaaggcaagagttaaacccgggcagtctgattccactcacggtgtacgtctagtatcctggcataatgactcacagcattgaatcgatgccaaagtcgcccaaatgatctccattcttgcatttctccaaccctctccacactatatccagaaagagtactctacgcattaaactgcccttgccacttcactgtctaaaacccttcaatggctccctattgccctcctcaagaacaagcttagcttcattaccaggcctaccaggatcagcgatcttgtccttgctcttgtctctggcctcatttctcaccgtaaactctacaaggcagccctcctgaacctccttagggctctcaagtcacaactctgggactaagacagcccacaaatggaaatacagcaagcacagggagaaatggatgggagcagaaaaaagatgctagtccccccactccaacccacaggacccaaacttacacaaaccatgccttgtgctttgccatgtctccattaacaattcatatattatgtcaaatccctcgaattttaaaataaaaataaaattcaaaggtaaatgttagaaatctatgcatttatggctactgcctaagtcctattcttttggaatcatttctagaaagggtaaaagctgaccatactcagtacactggtcaaagtctgaacccagaataccaggaaactccatcctccaacaccatcccccaaagcccactctgcaaaggcaatgacatttcacaatttctccagcattcttgaaacgctgagggcagtagtttgtgctaagcacacagtgaaagtcatgtccagttggccgttggttcatgctgtggctactgccaattctttaagtgttccctcacctcaaatctttgatgcacgaggtccagcagtcgtcactactaagtcaacactgagacatgtaaatgtttgtgaaatgagtaataaccaggatggtacaattaagctccccatgagctcctccccactgccacctcaggcctcaccagacattcatcccaactgtggaatcctgaagataatcagagcccgggaggcagatcttcacccctctgagcctcagattccccagaagtaagctgggaacaataactcctatttcacatggctactgcaaggatgaagtgaaataaaatgtatggaagcaccaagccagtgactaatcctgagatggcagcacatgataaatgcttactgaatctgggaaagcaaaattattctagctcaataaagccttttaaaaagaccagcgaatttagcttcaaattcagtgcaagagaaataatcatcctgggcccaccatcgggtcatatgccaaatgtcttaaatatcatcttatttaatctttgtaactatctgtgcaaatgatccccttttcaagtaacagtaaattgaggctcagtcaggttcaataatttgctccaggttgcagagaaagaacatgggagatcccataagaatttgaactccgttgaatttgaacccagacttcgtgtctttaatctccctactactctgttgacaagaccctgaagccagagagagaggaaggtggataagagtccagaaagggcaaccatgccaagttgatcagcacaccttcatcagcacaagtccaaatgaccaaaggcgagtgtcactcaagggcaaaaagatggggaaaggtaagcaatcagtttaactgcctagttcagcccaactaggatctttcagtgacagagcttaataatttaacagcataagtcctttatcagcatgaggcgggtgactccctggcactgtgattttaagcaaatgactatagggcctctctatgcctctgactgcttctataaaacatggagactgtgaaatctcccctgcagtgatgttgtaagggttaaagaaataatgtgtggagattacttcacgcagccttgttatatactacatgcccaaggaacagttctatgattatgaggaccctttcacaactaggatttctatagccccttccttcttcctcatttgctgaaatgagccacatcatccctcaacttctcctgttccttacctccctctcccttctctgtgcaccctactcattgactgagaccacaaatgcttactgaataccaactccggccagctggggaatcactcacgctgttacattaagctgtatcactttgcctttgtggagcttacattcttaaacttgtaggagagcggggaagacggccaatgaacaaataacactaccaggtacagtcaagtgttataaagaacaaagcagataagggtacagagaataatccctggaaaggcagggctgggtaaggtaattaggaaaaagcctatctgaagaatcaacgttgaatcagaaagctgatgaagacagagatcaggcaatgaatgatcagagggaatagttctgcagacacagggtaagtggttgacagaggccaacagtatcttagaaggctaagaacacagctcaattgcagtacccactatgttttagtataactacaggtttataggccagttgtacctctgtgccctctgaaggtaggagctgtgtttcttattcctgtctgcattcactcagtcatatttatctgcccaacattctataaagaatgagctgtaataagcattcagaaaatatttgctacataaatgatatttgtttgatttttcagttgtgggggttaattttattccctgctgaattctgggctttctgaagccccatttagacttctttgtatacccaaaagtgccattgtccctcaacttctgctatccacctctcccttctccatactaaactgctcactacaactactctccccctgttctctcacctctgcctctgcatgaattcacctggactgccttcttcatcacctccaccttcctcacaaactctcaagattaatctccaaatttcattagtgtactgatattatcatttgttcaaatatttccaaatctctcaagttcttcagtaaaacttttccatcaagtaacagaaagtgatgcatcaagtgacaattgcagattgagtggtaaagacagctgaaggacaaatgatctgaggttacttatgtaatttcttttcctcccccaaatatgccatatttcagtgactttctgggctttgcgcctgcagaactagaccagggtacgagggcaggaatgttctcactactgtgggtctgtgcactcaatcactcacccataaaagaaatgccttatttacagcaaacaaaaccaatttaggacaaagctatcacttaacggtcttccccacaaggaaggtcaatagtttagcatctaaattatttgagatggattcccttttctaaaagcagaaattgcagctgtacttcattttaaaaaaagaaaaaagtcaaatatttattctcctaggcaagagggagatacaggtaagtcacaacttccaatgcagccgccacagcctcatttagctgataagaacttgcccataacctttagtccttcacttacaaaagtcatgcattcatctttctcctcccacttccgtaaaggcagaaaattaggctggagccattctttctgagtatacaacagcaggggcatgggtttaagcagtttctttgacaacatacattcctctgtaagtccctggacagaagctctgggctgcacagaaaacatacaacaaggattctaaaataggaggcctggccaggcacagtggcccacatctgtaatcccaacactttgggaggctgaagggggcagatcacttgaggtcaggagtttgagacaaacctgaccaacatggcgaaaccccatctctactaaaaatacaaaaatcagccaggcatggtggcgtgcatctgtggtaccagctactcaggaagccgaggcaggagaatcgcttgtacccaggaggaggaggttgtagtgagccaagatcaggccaccgcactccagcctgggtgagagtgagactctctttcaaaaaaaaagtaaaataaaattggagacctgaaaggcagtgcttctcctacaagagagctccatgaacttccactagccaaagagaggggaaataccctaagagacaacaaaactgtgcttagacttaagaaccatttcaaactcagtgccctcagccaacatttcccctaagacttgactggcagtatgtactcatatcttgcccaccatggcagtgcctggctatattacaccaccaagtactgcacacacttttcacttggctatatggacacagcaacatggcccctgtctaccaggatttaggtctttggaaagacttctaaccatggttagacccttactgctaaattcactgaacaccactctgctaaaagtttcaaagccagcctaacttagatttataacagggggcgtgtacagtacattaattacatgcctgtgctttggctgccaggactgggattcagcctctgtatggtttaaacccctgaaacctccttagcagaccctgcaggtctccacatgatttggcccttgtcttcctctcagacctagtctactaccactttccccctctaattacctagacatgcccagctcattctcatctcagtctttgcacttgctgtctgctctgcctaacacactcttccccttagtctcacctagctggctacctttcatcgctcaggtctcagctcatatgtcaaaaaggccatctccaggatcacttacatataatgctgagcaatgtgaagtatgtgtatgcctacatataatttcacctaaagtacaaaactgaacaaaaccagcgttataagtcaggggactggtgaccctttgtagggtggaggtagtgacaggcaggagcaccagggggcctctgggttgttgttaaatgatcgttttcttcatctgtacctagttagctgggtttgcattcagtttatgaaaattcatcaagttgttcatttgtaattgttcatttttcagtatgtcttatatttcagtttaaaaaattatgccaatcaaaaacacaccatatcaaataggtctcctctgatcatccagtctaaactaccctgctgtgaagcaatccattctccatcccatgaccctgactgattttcttcacagaatctgtcattggctgaaatcattttcattattggttatatgtgtactggctcactctctcccacctccattaaaataaagtatcacgtggccaaagactctgcctgcctcattcaccatccccaaaccccagggcctacaacagtcctgccaaatggtatgggctgaataaaaactatatgaaaaataagaaatgactaaagtggaccctttaaggacgtactatcaatcaaaagtcaaaacagtaaagctaacagcaaaggtgaaaaaaaaaaaaaaacttcaatgacactaagcatcaggaatatgtgtcaaatgttaaatttaaccatagggaggaggtagacaaaatgtcattctatgggtatctttgagagaccagttaaagttatttctctaagcagaaactgggtcttttatttctgtacagacaacagtttttcacaaggcctggtggtataaaataggtctgggccaagagtggcaacagatttctgagacacttggtgaggattcttaagtatgatgagagaagtgggccatgtttaactgcaatgtctgccacgggcaagggactatggaaacgtaatatcaaatcagtgtacatgaaacagatcataggaagcacccaagaatttgaaaatagcaatactcaccatttttatggacaattctaagatggtcataaagaaaaaaataaaaatgtgtcagtggtgctaatgacttggatgttatatagttactactggcatgcagattaatttgcatgttgatataatatattttcatgaggaagtatatactcaccaggaaacagcatggtgtaacggaaacgtaaaggtaagcctttactctggaatgccacaaactctcactgtatcgttgaatatgtcattgaacttctttaggcctcaatttctctacccatgaaatgagctggctggactaaatgattgctaatgtccatttccagttcttggacactgtgtacctttctatctttaaaaaaacctacttttaccttctaagaatttacagaaaaacacatcatccacaaatatgtaaatcacagtaaccagatggggcgtgctaacagatctttttacccagttttcttgacaaaccaagagtatctctccccaaccagattttctcctgtgttgcgttcagcctcttatttcttggttagggaagtaggcttcacatatttcagctaaacactctgcattttcagtttctctgtacaattcatgagttttcactgccctgggccccatgtttctcatcaattcaagtctacactcatggtaagcaccctagttcttgttttttctaacacttaaataatgaataggacttcatctcctagagctattctccttactctattacaacagttattagtgagttttaattagacaaaactgccattccttttgctacctcactatactgtcaagcacctattaagaatattacagtagtaagtattagcaccttttaaatttacattaacaataacagagaaatggggaggcaggaaatgaaaggagaggggtaaaaatagctcacagatgtcataaccaaagtttagaggaactcaaaaaatcattaatcactattttttaaattttctaaaaaactatactatgcacatcctggttaaaattgtatgagtgataatttgcctctcatcaattaaaaatggggaaataggcaaggtcattaactctgctgtggctgaatcccagactgtgctttctttaaaagggaagagagatagtctacggagactaaccagttcagtggttgagtgatttctacaagagtcatcaccaactcaaaactttcctgaagtccttctgactattttaacgcttgccatctgcagaaggtaaaaatctgctagaggccaagttccaatcgctatccagcccaccactgaccctctttgatttcattctccatcaacaaggaggacatggacagggtcaatggtctaatgcgttttagtgacagccctgatttttcattggaaagaggagaaagatcgtttcccatttttctccttgacccacggatttgaccaactcaggcacattaaaagtctgcaaaagcaggtagcctgcaggaagttcaccctagggggtgagttcctagttgggctgaaacgggtttccaggcatgtttatcacgtggtctaaacgtgctcagggttagtgccagaagtttgaaaagcagaattagtagagctgacaataaaacctcagggctccaaaacccggtccaagaaacttttcttaaacttgcgtccagcgcctgcttcagcgccttcgccatgagtctgcgcgggcagacagcggagactctagtgcgttgggtcgctcataccccgaggcacccggggctgccgccgcgccgcccctgccccacactggagcggggttccctgctgcgcctggacccggcgccgcgtcacctcccgaagtggggcgcccgaggggccgcgcagggggtcaggcggagaccaagagtagcagggggcgagggaagcccgggcaggccggcgccgctgctggcgcccgcagctcctgcccccacgctcacctgggacccggccgccaggaagcggggccgcagcgctagggctcgcagaagcttcccggcctgcgctgctacgggggacgccatcttaaacaggaaactcggcacggggcagtagggcgggcgcgggcaggggaaggaggcggaggaggagcagcgggaggaggggtcagaggagaagcgggcgcggggaggaaaaggaggaggaggcagaggcggtctgggccgggccgggcctgacccctgcgtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcaggtgagtcaaggagaggccattggaggctctccatcccttaaggagttgtgggtgttttgttttgttctatccttaacctaaaatcaatgtaaagctgagagatgaagccgggtgggtcggttggggacttggagaacttctctgtctagctaaatgattgtaaatgcaccaatcagcgctctgtgtctagctaaaggtttgtaaatacaccagccagccctctgtgtctagctaatcaggtggggacttggagaacttttctgttagctaaaggattgtaaatgcaccaatcagtgctctgtgtctggctaaaggtttgtaaacacaccaatcggcactctgtaaaaacgcaccaatcagcgctctgtgtctagctaaacgtttgtaaatgcaccaatcagcactctttaaaaagggaccaatcagcactctgtaaaatggaccaattggcactctgtaaaatggaccaatcagcaggatgagggtggggccaaataagggaataaaagctggacaccggcgccagtagtggcccctagttggggtctccttccaggttgtggttgctttgtgcttttgctttttgcagtagctcttgctgctgttcactgtttgggtccgcactatccttatgagctataacactcaccacaaaggtttgcagtttcactcctgaggtcagggagactgcgaacccactgggaggaatgaacaactccgtatgccccaccttcgagggctgtaacactcactgcaaaggtctgcagcttcattcgtgaagtcagcgagaccacgaacccacaggcaggaacaaacaactccggacgggccacctttaagagctgtaacactcactgtgaagtctgcggcttcactcctgaagtcagcgagaccacgaacccaccggaaggaagaaaccccagatacatttgaacatctgcaggaacaaattctggtcacgccatctttaccgcgagggtctgcagtttcattctggaagtcagcgagacgattaagaacccacgggaaggaaccaattccggacacaaagctattggaggattttaagcccagtaatcagagtgataaaagcaacattcatttggagctgtgaaccccaaatacctgacacaggtctcaatcaatttaagaagtttatttggccacagttaaggacacgtgcctgtgacacagcctcaggaggtcctgacatgtgcccaaggtgtggtggaggacacagcttggttttatacattttagggagatatgagacatcaatatatgtaaaatgtacattggtttggtccagaaaagcgagacaactggaagcaaggaggggcttctaggttatgggtagataagacacaaagggttgcattcttttgggtttctgattggcctttccaaaggaagcaatcagctgtgcgtctatctctgtgagcagagggatgactttgaatagaatgggaggcaggtttgccctaagcagttcccaccttaacttttccctttaccttagtgatttgggagtcccaagattatttccctttcacagagtttacgcgagtctaagcaatgtgcatataataaaaacaacagcaaagttactgaatgtgtgccaagcattagacaaatataaacttgtttagtcttcatagcaaagttttaaatgagtagaagtgtacaatccccattttgcagaagagaaaactgaggtgcacagaggttaagtaacttgccagaggtggcaggtctgataagagatgagattcacatcccttccacccacccccaaattaagcactattttagatttttttttttaaccttactcattcttgagcatatgatcatgaaaaaaggtacaatgtgacataagtagacagctgttgctactagcttctttcctaatctctctctttggaaagtgggggagctgaggatttttattttaatataatttctagcccatttcgagacatagttttacccactagatgtagcatcttttgatgataaggatgatgatgattgtttaaatcaattattgtcacgatggtggcaaagtggcaaggtctaactccatcctacatttattagtctgtattctactcagaaaaactgcactctttccatcatctccattgatgaaagaaaaacttcagctaaattaaatgtaaaggagtttaattgagcaatgaacggttcgccaatcgggcagctcccagaatcacagtggattcacagagactccagcgcagccacgtggtggaagaagatttatagaggaaaaaagggaaatgacttacagaaatcagaagtgaggtacagaacagctggattggttacagcttggcatttgccttacacagtttgaacactcagcaatgtataaatggttaaaatatggccactgggattgccaagacttagctgttgttttaggtccatacttctaagttaggttttcaatcttgtctacctattaagctaggttgcagttcgtccacaaggactcaaatatagaagtaccgagtcctccttaggccatatttagttcactgtaacactattcgtcggtgaattgttttattcacttgtatcactgtggactcatggattcttttttattaaatggcaaaccgatgctctttcctgatacatacactctgctgcctctgttttcagtcatttaatcttcacaggagccctgcaaatggggtcctactattattcccattttgccagagagaaacttggccacagagttccacatgacatttacatgactctaaggtcaagtaacttgccaagggtgacacagcttgggatcaaatttcccaaagctggactccaatcactcttagcaccctcctcttgacaaaactggatttgagtttccatattgttcatcattacccctactgggtccgccgggatagagcaaagacttgctaatgtttgagagtgaacgtttaaacttggtgagagcttgtgaacattttgccaaaaggaggaagaccacctatagaattaatcaaaggctgtttattcagacgttactatgctaagggagttggctactatcactttccttccaaatgagactagaagtcgtttgaaagaagtgttagttttatagagataaaggagagactcttaagactgtctttgattgatgagtgttcttttaagatgcgattattctattatggggggatttttgaaagtggagtcgggagaggctttctgattgtcatccaagtacatttggtattctttgatttgtttactatctactggtgcgtaacttggggtctttccagggttagcagcctcctaagagttttcctgtctgaattggaagactgtctcatccttggttctggggtccaaatctttcatcagcaattcctcagtgtctttactcgtattatctcattctgccttctctgcaggaaggtggtaggggagaagggacagaaggaagaaagagaaccatttatgtagcacctccagtgtctagcactggactttgattagaaaaagtaatcaataaacatatgtggaatgaattgcattatagagttcctcgtaagatttctccctatttcatactccccgcttccaccctccaacctcccccaaataggaatctctttgagaacagggaatctagattctaccagagttctgcactgtgctttcctggaacaagcattaagttttcagccaaactggattggattcaaatctgacctccacccccttgaacacctgtgactaggaaaatacctggttcatagggtagtagtaagtagtcaatgatcagatgttgcatgtaaagaccttgcacatagtaaagacttcatagatgttctttttcttcctctagtgggtccataacaaatatttgcttgatatcaaatgtgaaacactagggccaatctgagatgtaggttaggagacccctgacactttgtaatttatcttgatagcactggagaattacagagatgtacaaatgccagacaaaagtattaagagtctaaagtggttgcctccaagaagaggatagagagtagtggtcaaggaaccattacattttgttttagagtttcaaatattcagattcctggtctccacctcatactcatgaaatcagaatcacttaggatggagactgggacctgcattttaaataatctttccaaagtgttctttagtttgagaactaaaaaagcaaacaaagcaaaccatagtggtgaactctgaagatgtttcctggtgaatccaaagacgagttactctgctatcccccatttggttcctaaatataggacaaaaagttgataaatcatagatggagatgatgactggtgctttcagagagccttgacacctggtaccagacccattttctacccgtggtctaaatcggctgcgacatgtagaagcattggcttaaggtgaatgaacagctattctacgcttttgctgtgtcaaaatggcaattgtgaactgcttgaacagtaactatggccataggcaatagcactattgaaagcattctgcactctgatatcagactgaagcacagaggtagacattgcaagtgttgactctgtgatttaaaagctccatgaccctggaccagttacttaacaatctcaattccttgatctgtggaaaggggattatgatagtacctattttgccaatgagatgcatcctcaaacacttgagatcccagtggctgttacctaccataccttcattatttgactaagaactctttttcgtgtgtttatttctttagtatttacatctgtgaacctcagttttcctattagtaaaatgaaggtcaagtatgacatcttatttgagctgtgagttgacagtgtaacacttctcataaactgcatgcatttgaaatatgaagttgtaaaactctacgattaagctttgtatttctagcaccttggctatactgtttcttattcagttaattgttgcaaaaagaaaaataaaaacatcagcaggcctatatgccttcgctttcatcttagcagtgcctgttaacagtgaaataatgtgctcattttcatattcgcactgattactctaggggcgcagatttaccagagagacatatcatgaaacccagcaaagggatactgcatctagcagttctggtggtgttttatcattaccttttcacttgagcataaaaactgtttgacaaatactaattgtaaccagcagagctgaatagaatattttaagaaacaaccctaattttcatgaattacatatttgagttcatactgctgcatgtcaagaatgaaaatcactattacaatgatgaaataaagggcatctgtggatttcatctggttaattttttaatggataacagatttctggaatttacaggagactaaactttttggtctttcattgtatgcataggtaatatcactgttgctatttgtgatagccattttaaccagtgattcagttgtattgtttgccagtggcacagaaagaatggtcattgtgctcaagttatttttccctcttcaataatgcgttaaaatgattaattttgatggtatttctcagcagctttatttaaatgacggtcctctgtatctgtgggttccacatctatgattcaaccaactgcagattgaaaatattctggggaaaaaataaaaaataacaataataaaaaatgatacaagtaaaaaatacagtgtagcaactattttcatagcatttacattgtatttggtattacaagtaatctaaaaatgacttaaagtatacaggaagatgtgcataggttatatggaaatattatgtcattttatatcagagatttgagcatccatgaattttattatccatgggaattcctggaatcagtcctccatggacagtgagggacgactatgtaaggtgcctagaagaaaagggatttatgacaaaaactgtctcctttgccaacactgaagtgtgctcaagagaaattctcactgcatcctggagagaattcacaggaagcaagtttagagcagtggtgacagctcaaagttaagataagaaaggaggaagagtaaggaacatcattaacttagggaaggcccagctggagacaaggtcagtggaagagactaaaaacagagaacaagatgaaatggtggaaacaagggtgatgacattcttttggcaggaagtttggagctggatgaagaagatggtaaaagctgaggaaagaacatttacacaaaggactgtggaggttcttgaaccgaaagagaaaagtagcattagattgactgtggaaaagaagttagaaacaaaacctaaattcttattgcaattggaacctgcggagttcagcaccttcaatattattaagatagcttcttttaaacagtaaagtaaaaattaaaggaacattcttttacaaatgtcctgcctcattataaagtgagcagccacagcagtggttctttttcttcttctcttttttattttttgagattgagtcttgctctgtcacccaggctggagtgcagtggcatgatcatagctcactgcagctttgaattcttgggctcatgcaatcctcccacctcagcttccagagtagctgggactatatatatgtgccaccacacccggctaattaaaaaatatatatttttatacagatgggctcactatgttgcccaggctggtcttaaactcctggactcaagctattctccctcctcagcctcccaaagctatgggattacaggcaagagccactgtgcccagccacaggccatggttcttagcttaggtgtgtaacagaattcctttgggccatcctctccagaagttctgattcagtaggtctgtcttggggcttgaggatctgcattcttataaataatgcccctactccactgtctttgttgtaggtggttcatgcttcatggttggagaaacaccaacatcagccgggcgcggtggctcaagcctgtaatcccagcactttgggaggccgtcactggcagatcacttgaggtcaggagttcaagacctgcctggccaacatggtgaaatcccgtctctactgaaaatacaaaaattagccaggcatggtggcaggcacctgtaatcccagctacttgggaggcaggggcaggagaatcacttgaatccaggaggcagaggttgcagtgcatcaaaggtagcactttggcatagctagagggaatatcagcagctatcccattcccacctttcacattttctcttccctttcttcccctacttctaccatcctcttcaaactttccccagcccctctaaaacctaatttactacatgccagcaagaagtatggactgaggctccaaaagatgcctctatgctcttccctctatctgaaacacccttccctgttgttcaccagcatgagtttctctcatcctttgagtttcagtcacccccttcaggaagcttccctgaagcgggagctaggggtatctcagtggttattagaggtttgttactgcatttgctacttgtctgcttcatccttcaggattttaaaatctgcaatgacagggaccgtgttcttgcagtgttattattctgcccacagtacagtgcctggaagacaggaggtgcccaactgctattgactggatgggtaaataaataaagatgaagctggtgcaaaaatctccctaataagaagatgcaaagattcatgagtgtctggaaatctgccagtagtccccagtgagaaaggaagtggaggcccatgaagggaaataacctgccctgtgtgatgcactacactagtggtttttatgtacagttcctcagagtccttggacaccatagaactccatctcactctctccttctccctgcttttattgaacacttaggtgctttctaaatgctttacagaaattatcttaatcctcactaccgacttattttgcagacgtacaaactgagtcttaaagcagagagtaagtggcctgatgtaaagaataggagaaggccaattccaaccaatctggaattgattctaggccagaattgtccaatagaacttcctgcaatgaggaaaatgttctatatctgtgctgtacattatcatgctatgtggctattgaacatttgaagtatggctggtgcaactgaagaaatcaatttttaatttcatttgattttatttaatttatacttaagtttgaatagccacacatggctagtggctatcatactggtcaacatgggctatctaattctgatgtacagtctctgcatcatcattccattttctaaagtgggtttctcccacagcagttgttaaaacaaggatttggatacaaagagattatttaagaggtgatcctagacagcaggagagggattgaggaggtgagatggagaaggtgaatactagtaaaagactacattgatatgctgtaggcacttgaggtttctgtttgtttgtttgtttgtttttttggaaaccttcgagagacttatggaaaacactgtataattgtttcattgaggagcacggaactgatcatgtttattcaccaactctcatgcctttttggttgaaggatgctcctaggggcattcacacctgctctgaactccttcttcatctccagcctgcctcccttatgggccatttcatgccactgtacctagataaagccttagggccaagagattcaggtgcttgaggctgggtctatccttctgagctgcaaataacttccagggtggatcaagggaatgtggggtcaggatagattatattgcctctcatttacaaccaaccatattagctcatattagtgttttatctggaataggaggagaagcatttgagactgttagaaaaaaggttctgctatttaaaaaaaaagttttgaaactgtagctctaaactacattcctacctgttttcctgaccacctcaattactaacttgtatcgtgttccatattatttctagcacagcatggattctctaacattcttgcagtctgggccctgcaaggtagctgtaaaaatgctgccctgggactttctcagtggagacataagaagactcaagcattccagaaagtgtttgtttggttggcttttattgatgtatataaaaagattagagacagcaagagaagaaaatcagagagaacctatacttggttaaaaaaaaaaaaaagattttacagcagaagtagatagaagtggtgcaaatgatgatttctcctcttctgatatcaagctttgttaagttcctggaaaagcaaacgtgattatggcaggagtaaattgactgaaagccaagtcaaagaggcagatcagcttctgaaggaggtctgctcacttcagcaaagaaagcagggcaaagaatcctaggcttttgagctagttaggcccccagttcctacaaccatgggctgaaataatgtggagaactcttgatattgtaggcaaaatgaatgttagcagagttccatcagagataatggctggccatgagctaaagagagtttagccaccacaaagaagaacctgcctgtagagatatctctaagctaaaaacctctgcaagtttcctttcgaaattctaccttaaaaatttgaaataacctcagatcaaagttaacgcaagagtttccagaagagtgaagttcataatgccacaaggaaaaaaactagaggatgactaaagtaaaatttcattttaaaatttttattcatctagctgaggttggaaagagtaaaatttttacatgaaaatattaagtatctagaaactcttataaaaagaaaaattaaaaagcacaatgatagacaaaaaggatgagaataaacaattcagaaaaaaaaatagaactgatccataaaaagaaaaaaatggccaacttcacttattgcattgaagaaacacaaaataaaatataatactgcctattaaagttgtacatttttaaataaattaattaaaatgcccaatgtgggtacaattgtggaggcagtgagcactcttctacttgttggtagaagtggaaattaaattgttacatccttctaaaataatttggcaatctattaatatattcagatcctagaatagtttaaagcctccagtccaataatttattatatctatatattgtctgttcatatattttctatttatatatatatctataatctgtatctacatatatatctagcctactgcctatctttgtaaataaagttttattggaactcagccatactcattagtgcatggtattgtctatggctgctttccacctgcaatggtagcattcagtagtcgccctggagaccatacaactaaaaacatgtaatatgcagccctttgcagaaaaagtttgctaacccctgcaccagaatataaactctttgacatgtaagctcaatgagtgcaaataatttgtctgctttgtttgctattgcattcccagtggctagaacagtgcctggcacacagtagatgctcaataaatattagtgaagtcatcagttgctcctattaaagtatattcatattgtttttacatttagtgggtttttggttttacaaataatgttgcagtgaacacagatctttgcttacttttgcaattatatcagacacaatattttaaaaaaaatagttaacaactttaacaacctggaaaaatactgttgatatatcaaatttttaaaatagactaaaattttatagatgactctaaattttgtttttaaaagtgtgtgtgcatgtgtgtgcgtgtttgtgttaactataaataatttgaaggctaggaggtgggtggggtgattttgatttcctttcctttcttttctttttgttttttgttttgttttttttttttttttttgaagtggagtctcgctctgttgcccaggcttgagtgcagtggcgcgatctcagctcactgcaacctctgcctcccaggttcaagccattctcttgcctcagcctcctgaatagctgggattacaagtgcacgccaccatgcccagctaatttttgtgtttttagtagagaccaggtttcaccatgttggtcaggcagttctcgagctcctgacatcgtgatccacctgccttgacctcccaaagtgctgggattacaggcatgagccaccacacccgacccatttcctttattttctagactttctacaatgaacacaaattgataggaaaaaaataaaatctatttttctaaaaaaattaaaagatccttttccttttgttacttccatgtccttttttttttttttaactgtaatactttctgttgctacaagtaaaatccaaattcttccacctaatgcttcattctatagagcctctggtttaaatatatgtttctgactgtctctgcaatggctctcctgcactgatggtttatttacccagactgtgatagtctttgtcctcagaaaaggccatatacattctagtttggcacaggtattcacagcttttgaactgtccagaatgccgccctttccaccaccttcctgagctcactgctgcagtgcttagctctttccagtagccttcctcagtccttctcacagtcaaatcctccgtctctaacctcctgcagcatctaaacccagttgccttcaggagacaaagcaaggaaacctaaatgaataaagtaagccaaacaagggaataaggagtcctgggagccttgataacatgtatgtgccctatctaaaggcagtcaaataaaataaaaacattttttttaagaagaagatgaaacaaaggcaaggatgttgataaaatttgccctgtagaccatgaccttatactgcctgatcttataacctacttgaaactttgctttaaagcctgtggaattcaggaatgcagagagagctaggggaaagtaagagttaactaaagttcatcacagcactgttcacaatagcaaagacatggaattaacctaggtgtccatcagtggtggattggataaagaaaatgtggtacaggtacaccatggaatactatgcagccataaaaaagtatcatttcctttgcagcaacatgaatacagctggagaccattatcctaagcaaattaacacaggaaagccaaatagcacacgttctcacttgtaagttggagttaagtattgggtacacgtgtacataaagatggaaacaagagacactggggactactaaagggggagagaggaaaagggacaaggactgaaaaactgcctattgggtactatgcccactacctagttgatgggatccttcataccccaaacctcagcattacacaatataaccatggaacagacacccctgaatgcacatgcaccccctgaatctaagacaagttcaagttattaaaaaaaaaaaaaaaagatgaagatggggataggttgagaatgaggaaagaacaagaggttttgggattaaaaagaaaggtgaggctaaggctttagaatggagtaaggatgtctgtggtagaagatatacagtaatttttagaatgaaattctggtgttttattttttaagctacaataaaatatctctagtattaatatgggttaataaaaacagcccaatgaaaatattacttcatatttatttatttatttattttgagacagagtctcactctgttgcctaggctggagtgcagtgacatgaactctgctcactgcgacctccgcctcccaggttcaagtgattctcctgccaaagcctcccaagtagctggaattacaggtacttagcaccaagctcagctaatttttatacttttagcagatacagggtttcaccatgttggccaggctggtctcgaacgcctgaccacaagtgatccacccaccttggcctcccaaagtgctaggattacaggtgtgagccaccaagcccagcctcttgctttatcttctatacctgccccaaacttctacttgttgtaacaaaaacaacaaatggctaagctgtgttggatctgtgttatgtgcaggcactgtgctaagcagttttcctggaagtgtctacctcatttcgttctctgaatagctctaagaggtaagtgctattgcactgttacaaaattagaaggaaaacgtacagagaagcaaagtagtttaccttagatggcatggctaggaggtttcaggattgacattttaccttagactccagtctagagtagttccttttgtttctctgaggtgcagctctgaggtaaaagaaagggaagatttggtagcaagggtgtaaatgaggatttcattccctctgcactattgtccttttgggctggaccattctttgttgtggggggctgtcgtatgcataatgggatatttagcagcatccctggcctctactattatatgcagtagcaaatgccccctcctttacacttgtgacaatcaaaaatctttctagatactgtatctttctaaatgttgtaatgccaaatatcccctagaagcatgatatggttttggtgtgtccccacccaaatctcaccttgaattgtagctcccatatccccacttgttgtgggtagttactgaattataggggtgggtttttcccatgccattctcatgatagtgagtaagtctcacaagatctgatggctttataaagagcagttcccctgcacatactctcttgcctgctgccatgtaagatgtgccttttgccttctgccatgattgtgaggcctccccagccatgtggaactgtgagaccattcaacctctttttctttataaattacccagtcttgggtatttcttcatagcagtatgaaaagggactaatacatgggggtggggaggaagagtaaaatctcccctggttgagaaccactattataaatatttgttcttagagcagaaataccgtaacacttaatattgccaatctcacctttttgacctttaataatcctagatatatctcctccctccactaaaaaaccactaaaaacaacaaagattattgcatgaaatgttttattttcatatatctcatcttttagagtggattaattttttaaaattataacaagagggaggcaaaaagttttaactcatgaagcaatcattaaatgaattaaaatagtaattctcatgtcattagtttgattttagccaagccaatgaagcactattctaatattctgcacaaaatagcaaatttcaatttgaaaattctccaagccattaatggtcctgctatccatctgatttagtaagggttcagagcatttgtgagctaaactttctcaggaagtcatttttatactatcagcattagcctgtgccattaagatcagcttttccttgatacaatgagtttttatgttattgtctgtgtcttgtggaaaagtataatttttaatgaaagaaacctaagattctttcattaggctccaaattaggctccaaattcccccactgtgatttcatctcatcagtctgtgcaaggggagagtttggtattccaaagaaaatcaattcaaactactaaaaacaattgaaaagtgtgaaaaatattttttaaatatttgagtatgactcaaaatacatgctttatttattggtcagcgtgaacaaccccagaaggaaaaagagtgctgttgttaaaggtatctggcatcatggacccaaccatcaccaggagtttctcacttcatctctggtgagtttctctgtttagcattcctttcaaagtaggttttttctcaaggtggggaacctaggagctccagtgtcacatccatacttcattatgaccaaagaggaaagatagccctagctcaagtctcaaaatatctaaaagaccctcatgaggtcagccggagtcccaggtgtattcctggaaatctcagtggccaaagaggtggctgccatgccgtttcaagtcagattcaggtacaagaggttttattaaggaaattttcttagtagaaaatggtaagggtatatgaaggcaggataaagaagagaaaattcctggtcaaagctgcaatttcagatgaagtgccagccttgggccacagagagcttagagcataaattacatgtcagaatttgtccccttccacagcaagggagctgggcaaaagcaacattgtgccagtcattggttacagcttgccttggtcagtgggatgtaaaccctggctctctatatgcatggcagccctgttagctccaaggtaatcctctgaagaaggttgcagatacaaactttgcagcaaaaggaagaagtagttgggggctgggcacacagcatttggtagaggggatctgaaagggctgcatggtgttccctgcacacacctattcctaagtgtccaaaatgttgggtctctatgattggcaaccccaataagcaccatgcttttgagccagggaggagagatttaccaaaagagggactatcctgttgctcttttgaagaagaaagaagtgatgggcagacaaaatctgtatagcttcagctgatttggacttaccaaagttgaccccaagcaagttgcattaaggtccgataaacacacacttagaaaaggacagttgcatttactgcgcacctaatactgttttgtcaacagctttattgtagtataatttgcatacaataatggcacacatttaatgtgcacagtgtgataaattttgacatatgtatacatccatgaagccggcaccacaatcaagataatgaacatctcgcttaccccagaagtttcctgtgccctgtcactcctccgtattcctccatcctcaggtaatcactcatatactttctatcactatagattattatgtattttctaaaatgttatataaatagaatcctagagtatatactctcctttgtctgttgtatttattttgagattaattcatgttggtttctgcatcagtcgttcattcctttttattgctgagtagcattctgttgtaaagacataccacaatttgtttgtctgttcacctgttgatggcctctaacacttttacatgtcatgttgcatttatctgtcatattcttttcacactactgtgaggtaagtcttattatgcccatttaagggaagatgcatttagacttcagagagagaaactaagttacctaattgctcagctaataagaaacagagcttagatctctgttttttaactcagtaaagcctatgttttttttcttacttcaccatctttctaagcacagatctgcacacaaagttagatactcattagttgatttttatctactctaattagcacaacttacatattcagaaaagcttctccaattttatatgcttactttcagctttgatgctgtatttataccacagttgggaaataacctattttcttctctgttttctcttcaaaataataaaccagaagaattcagtatccaaaatttggtcgtttttactctactatactgaacaattagtccattttactatcatgccaaacagctcacactttaacaaatcaacactaagtgtgctctattcagatgccttgaaatttcaaagtaaaatggcaaatgatactagatgaaaaacgttaagaatttcagcagattttgcagtgatgaaactttgtcttacctcttagaaaatgccattgcgctgactttagtgccttaaacttctaaattgcatttgacttacatgttttcacttgtgtgtgtacagtctccccaattcagttgtgaactctttgagatcatctagcaagccaactctctataaaatctgtatgtccgagttcaaagctctaactccactcaacccagatggtatacattcaaatcctgttggcctaacattttcaaatggaaagaatacaattagaaagattttacctgaattatagaagcctcataaagcagtgagagcctagaggctaaggagtcatggggaagttaaataaagtcttagtcatgaagatcctgttgaagctctgtctgtatcccctaagtgcttgcctctgtagtcagcttactgaaaaccctttaattctctccacctaaggtcatttctctgtctttggaagcaagcttggccagcatgcagggcaggctagaagtgcagaaaggttaatgctccaggaatcaatcctaaaccaataacagaaagttggtagataagtaccttagcacctttgcttctgggaaggggtaattctaaagctgttctactttgttttgagttcccccagtgagttgggttctgttacccacagcagtcagctgctcaataaatcaccctttattatcttccttctctgtctcatgtctcagtttttctccctctgtgtcttgggatcacttctcaaataaacttcttgcaccaaaatccctgtctcagaggctaatatgggggaaagccaaagacagacgttaaccaccatggcacgtctatagcgtattgggttaaatattttatatacattaatccattcaatccccataatgaagataagaggtgggtatttttattcttatttgatgaataaatgaagtctgaaaagttaagaaatttacccatgtttacactttatgtggcaaagtcaggtgccctgcgcccccaagtgagtgaatcccaaccctatgttttgtatttttgtttttttggtttttttgagacagtcttgctctatcacccaggctggagtgcagtggtgtgatcttggctcactgcaacctctgcctcctgggtttaagagattctcatgcctcagcctcccaagtagctgggattaccggcacccaccaccacacccagctaatttttgtatttttagtagagacagggtttcaccatgttggccaggctggtctccaactcctgacctcaggtgatctgtccgccttggcctcccaaagtgctgggattacaggcgtgagcgaccatgcccagcctcaaccctatgttttacacactataaaaactctcaggctagctcccttggaattgtggagtacagaattaacccaacctcacctgttagcactggaaaatgtcaacatctttttcttatatttatgatagtgcccaggaaaggactgggtacattacagctcccagtaaaagctggttaaattgcaaggattttttctttatttgttgtgactcttgtgaaaccttgaccagcaatttagaatgaacattggctttgctagctgtgtttgcagaagtaatatcaaaatgatatcctattcatgtttctgcaagagtaatgtctaccattcattctggcctcactgatggtgtgctgataagattactataagtgaacattctcattctgtgcctctcattattgaggaaggaaactcaaggagttccaaatatattttatttttttaatatgataacatgcacacacaattttcctcattcttgaatatatgcaatttatctatcagagcaggtttcattttttatgcacttgcatttattcctttctcatccatgtgtcagagagaagggattgtaatcactgaaggagcatttgtataataaaagtgatatctgcaattccttcagagaagagcgtgaataaataatctgtacattcttaatgcattgctccaaatatgagtttcaatttgcacagaagtttcaataaattgttttgtgtccctaaagacctacagatgcctcatgggatacattgtaaaggattccatttagaaagaattttgcttgtgagtaatatattctctatacttttcttccctttgttaatgcctaatgacattgaataatacaatcacttttttcttttaataagtgatagatacaacatgaacttcagtctaaagtttctgacttgttcagaattcatcaacaacttttcattcaaggatttcaaagcacagcatacaaccaaaattgaggtcaaattgtgatgtggtttggctctgtgttctcacccaaatctcatgttgaattgggattttgagtgttggaggcagggcctggtgggaggtgactggaccatggaggtggttataatggcttcgcaccatcccccaagtgctatcttgtgatagagttctcacgtgatctggttgtttgaaagtgtgtagcatcttccccttctctatctctgtctctctctctctctctctctctcctgccatccgtaagaagacgtgcttgcttccccttcacctctgcaatgattgtaaatttccttaggcctccccagccatgcctcctgtacagcctgcgaaactgtgagccaattaaatctcttttcttcataaattacccagtctcaggtagttctttataacactgtgagaatggactaacacaaattgtaacttgaatttgtataataattaactttgcatttaataagtaatgcacactacgctaagttttatgtattttatctttacaatattcctatgatgtgggtgctatactcattttattgataagcaaactgaggctgagaaaggatgctttgcaggaggtcacacaattgttacagtgtttaaatattaatcacaagttttgtcattttatacctttttaatcagtactgtacagacattcccctgcaggttagcctaaatgtcaaataatttctctgtaatagttggtacttgttctgaaggcattaaatagcttgtgatttacattatgttgctgaaggttttacataatactttgcttgaattattataaaaggaacggcagttaacattgttgttacatctcaatcaatgttaaccaattcaacttagacaataacatcaaattcttcatgtttttgttgctttggtggtttagaagggttctgaaactctttacatacatatgccaatgattcatttctggattcattgtgctggtagtatggatgaaacatgctgttttaaacataaattaattacaatgggcagaataaataaagattctacctcttaaatttatttatttattttattatgatgataatttttttgagactgagtcttgctctgttgcccaggctggagtgcaatggcatgatctcggcttactgcaacttccacctcccagattcaagtgattttctgccttagccttctgagtagctgggactacaggtgtgcatcactacacccagctaatttttttttgtatttttagtagagacagggttttgccatgttggccaggctggtctcgaactcctgatctcaggtaatccacctgtcgcggcctcccaaagtgatgggattataggtatgagccaacatgcccaacctacctcttaaatttaagtaatttttttagcttaaggatgttatgaagcttcaagtctgttatctaggaagcttataacactctaacattaatagagtatcatttttgtaattgtttataaaatttcatgtgaaaaatgggaaagaagggagccaaaatgttttaaaaaatctttttggacctctaacctgtgccaagcatattccaaggtgttaattacttccattgcattgtggtaacagcttgagaagtggagtgctgatagtccacatccattttatcaaggttatgcgaggtcaagaaatttgcccaagttgaagtcacttggaagtgtcacagtggggattttttttcctttaaaaaattaaaaaaatttttttctttatgatttttttatgcatgtgtatttttagtagagacagggttttgccatgttgcccaggctggtcttgaacttctgagctcaaacaatctgcctcagcctcccaaagtgctgggattacagttatgagctaccgcacctggtccggtgtgggaattttaatcatggacagtctaacttcacagtgcaggccttttctgtttcagcatatcccaaaacatggatgacacaaaccagtaactacaaagatgataattggtgctatgtgaaaattacgtttttatatgggccaaatgaatttggttaacaataggtggaacaaagttaaccgtatttctttactataggatttctcagagcccataatatgctaattcacaaactaaatctgagttatggcaggctcctaggattctaaccccctagcctacctgtcctatctgatcttccactgagtgagggtgggatttgtgaaactgatgggatagcactcctgtgagtaggcgatatgatgtagcaaaagtgaaggatcacaaatcagttgactttacattagtcaaaaaggagaatctcctgtgtgggcctgactaaataagagggactgggctcttcgcactgaccttgaagaacagacagctaagtgcgactgcctgtggagagagtacatctctctctgctgggggcctcagttcagcctctaccaggagctgaattctaccatatgagcttgaaggaggaccctgaattccaggaaagaacatagctaacaccatgatttcacccctgttagactctgagcagaggacccagccaagccaagcttggactcctgacctagataaaaaatggttgctttaagctgctaagtttgtggtgatatgttatgcagcatagaaaactcatatggggatataacattttgttttcaagaaatctttctttttttccccagagtatcttatgggactggtgttccatagaatcaactttgggaaatgctgtgtttttatggcattcttttctccttcagagaaagactgatggttagacacagcctctgctaccaggaatggttggagctcgtgattcagagaagggatgcatgtccctttggtgaacctggtttccatgtgggatgaaggttgaagttgatgagttagtgaggtgaggttgacttgatggttggtagtgaggtgaggtgaggttgagtgggatggtagtgaaggtttagttgatgagttagcaatgtttagtgagagtgatggttaattttatgtgtccacttgactgggctacgaggtgcccagatatttggtgaaatattatttcttggtgtatctgtgagggtatttctagatgatactgacatttgaattggtggactgagtaaagcagattgccctcattagtgtgggcaggcttcatcaaatctgttgagaaggcctaataaaataaaaggctgcagcagaaaaaattctccttctctgtctgttttcaaactggaacatcagtctcctgttgcttttggtcttgggtctccaacttgcctattgcagatctttgaattttcagtctccgtaatcatgcaagccaattccttatagtaaatctatatctatagttgtatctcttattggttctatttctctggagaacctagactaatacagctgggttcacagtgacagagagtggtaggcacctggagtcatgagtgggctactcagataggtcctcacattgtgatatttatcctggggaattatcacagccaaggcacttcccttctcatccttaccgattatgaaattcacgctatcaatgtcccagaattgatgaacgattccttccaaaaacactaaaagaaggaaatcaaagtgcccacaatttacaatgataaacacaagagttggatacaccatctttgagtgggtcttattgggccatcttccccttacaaaacatcacatttgtgatgttttagatatgggtggtaagaaagaagggcacatcctaaacaacatctaggtttctgacatgttaatagaatggttgattcacagtggccattcctgagaaaggatctcagttaagtggagaaagatcattagttaagtcatgctgaacttgagatgcttttgaaacatccaaaaaaaaaaggagctgttgagatctgcctgggcaacaaagtgagaccctgtgtctacaaaaaataaaaaagttagctgagcatgcatacctgtcatcctagctacactggaggctgaggcagaagggttgattgagcctagcagtttgaggatgcagtaagctgtgttcacaccacttcacttcagcctgtgtgacagaacaagaccctgtctcagaacaacaacaacaaccaaaaaaaaaaaactgttaaaattaaatatgtattaaatatgtggtctctcccaggctgagcatatatatatatatacatacatacatacatacatatatatgtgtgtgtgtgtgtgtgtgtgtgtgtgtgtgtgcacgctccatctgcataaagataataattgaacctatgatcatgaatgagattatccaaggagggggatcaaaagagaggccctaagattcctgaggaattgctatggctaatgggctggtaaaggaggataagcctgaaaagaagacaagaaccttttgtaaaagcataagaagatagagtttgagttcctacttgaaggataattaagcttctgactatagatatcagtaggaaggacattcagggatagagggaagataatgaactaaatcattcagggcaaagtgagcagggcagatgaaggcaagggcaagttacatagtttgattgttgaggctgagaaagagagaactaaaaaaggagataattgccttatgacaagcagtctgaaatgctattgtacagatttgtattcatccagcagacttgtggttttgaaactcaggaggccaggtgttagtgctctgcacctcctgcccacacatcactgtggcacctttgctgctatcttttcatgtgtggctaacatagtattttgagacatgaagttgttatctatagagtcacagatatgaatctatattatgtttcctctgtgtatttccttcagctcaaataagaatatgctgtatacagtcatggcctgttttgtttttccatagtgaaggccacaggttggaaactcaaattacctagaaggatgagacagggaacgtaaacaggtgaagtggactgggtgcaagagaaccaggagatgatgaggtctgtagtaaactgaagagccacttttcttctttaaaggattcaaatctaacttaaacaacaaaaccaaacactgtgcaagccacacaatgcctgtctgtgcgctgtagtcagccccagggccacctatttatgaccccttgatgaaattttggaggaattgggtgaagaagataatagaaaagtaagaagactaaaacttacaggtatacataccaaaatgtgctaaagaagtaaaggggagcatatgatttcctctccccgtcccccaagattagaggtatccctccacattgtggaggggttggagagaccaaagggaagtttagaagtgcctgaatcctggggctgcctgggaggtagtaaagccttaggacaatggctgtccatgaacagacacagcatggaagcagcagagaccctgtgcactggaagggccaggtgggcaggaagagtgtgggggtaatcgatgctaattccttggtcccacacatcactgagaaaccaggaaagcctgtctattgttgagactttcggctcagctgaggatcccagcaccatggttcaaccctgggaatgtgggagaggtcacgaattagactgagattttcttccctcctaaaaaaaaaaaaaaaaaaaaaaaagaggaacaatcagaaattaagctgttattttaaaaatacaaatacagatatatgacaaattttaccaacctgggtctaaggcccaagattcgtgtctcttatgtacattctggagttctacagaaaaattatctggaaataaactgaattcactgctgtgagtgaccaattacccctatttgccacggctctctcagtctttcaaacctaaaatgctaaagctggggaagttccaagcaaagcaagacaaactgatttctctatcactgccaatgaagcactagcaaattccttccctgaacaagggtaggtttttgaagaggagagtgttatgatcagagctgtgttttgagatcaatctacttgccatgtgtataatgagtgggaagagaaaagaggccctgagaccagttcaagttgggcagtggctctgatgagagagagagggggtctggattaggaaagagggtgtcagaacatagagtagaggcaagattcagatgatgctgtagtgataagtggttatgtcaccaaactgggggatgtggagtcaggttttcgtaactaaataaaaccttagccatactggctgatttttaggcagtatctccatcagcctatgccagtagttctcaaccaaggagagatatttggcaatgactagatgttgttggttatctcaactggtgaatgctactggtatctcataggtagaggccagagatgtgtataaacattgtacaacacacaggacagcccccacaagcaagaattatccatccctaagcgtcaaccatgctgaaattgagaaacgctaagctatgtgaacctgtatgagaaacacattactattattatatagagcatatattctaggtctatgtaatgatgtatgctcttacagaaaatatttgttgcattagacaatgaactttttcaagtcagatatttttgtctctgattttccaaaacctagtacataatagatgctgaaaaattgttcagtgactgaagaacaatagccatcacttttttgagctgttaccgtgtgtcaggaacttctttataattgcatgcagtgttcataacaacccttagtgttaggtttatgatcccctcattttatgaataaaaatctgacgatcagagaggtaagtcacttactattaggttgatgcaaaagtaattgcggtttttgccattacttttgcaccaaccttgtagtaacaaaaggagccagtactgaaacccttgcatatctgactctgatgtttattttgctaaccacaacactgaaccaactctgttttaacctgggtccaaattgtattggccatattcaaatttccaattacccgaatgctctaataaggcctttataagcttcataaactatcctctcctctttatttttttgtttgtttattgccactctctaaacttgctattgccatatgcacattgagtttataaatgtaccacattagtcaggaacattctttttttatagcagaaacatttctagatgtagtcctgggatttatgtgttaatattaccagttggatagtatatttgatattattttagtagataagaaatccttgatgataacagcgagcaaaaattaccactcctcttcccgttaaaaaaaaaaatctcattctattattttggggtgaaatgtaacccagtgcattttcattttattcactgcttatattgttctctccgtaaatttattcaggaaagaaaaagaaagttaactgagatggggaaaattcaacagcaatgtacggtcagctctaaagaatgtatattgtcgtttaccactgttaggctgtctgatggttgattgctttctgaaagctctaaaaacaggagatcaatatgctgcaaaagtctgttttagcattgcaggaatttttaacctcactatactgctatcggtacgtggctagaatagactaatcctgcaaatagttcatagaaacccctccacattttttaccatctggccccaacctaacttttccatctcatcttctgtctccatctacactcctgtctcacaagatcaaatatcattgactgaatgtgccctaaatatccacctacctggatgttcaggtcttttggtctaaagtgttctactctcctaggtgaagaccagttagttcttcgaagccaaattcaaataccacaccaaatatgaggcctttcctcacctggttctctctaaccagcaatcgttcactcactcgttcaacacacttttattgagccctatgtcaggtactcttgagaaagtggcaaataaaacagatatggttgcaaccctccttgagcttatggccaacagcaacccagaaacattaattactgactttcctggattcccacactgttgctttttgtctctatttatgttctatcatatctttattattttttatcatgggcctacccctgagcatcataaaccattctgtgtcttattaatctttgcattttctcagtcccatccaaacctgtcacatagtagacactcagtagacttctgtgcagtaggattagattttctatgcgatacctgaaatagtacaataagtcaattacataattctatggttccactttaactaatttatttatttttcatttttttgagacatggtcttgctctgtcactgaggctgcagtgcagtggcatcaacctggctcactgcagccttgacctcctggactcaagcaatcctctcacctcggcctccaaagtagctgggaccacaggtgtgtgccaccacacctggctaatttttaaaattttgtagagaagaggttatgttaccatatgttaccaggctggtcttaaactcctaggctcaagtgatcctcccacctcagtctccaaaagcactgggattataggtaggagccaccatgcctggccaacttttatttttctaatactggtctctcttttctctttgactgttgccctggatttaagcagaaaaataagcaaatagttttgtctattcaaggtcccttgtttttttctgatttaaaatgccctaaaatttaaacttgatttattctaatctgtgctactcaatacacgtggccactgatcacctgaaatgtgattagtctgaattgatctttgctgtaaatgaaatccaatggaatatgcactggattttaaagacgtaaaatatctgattagtacttttgtattgattatatattaaaattatagaattttgattatattgggttaaataaactatagtattaaaatttttacctgtttaattttgcattctcaaatgtggttaccagaaggtttttaattgtatgcatggctttcatgatgtttctattggacagagctgctctagatgcttgtccttccccttctctggctcttcttccccgagcagttgctataagggggatcctatctcattctggtatttggggtgacagtccttaatgctggctttgcctgtagctagcttgttgcactttggagtccaaaggtcatatctgctaggcacataggaagacaaaagggtctagattcttggcctttttttttttttttttttttttgtctcccttaagactatacctgttagcagggctttccactttccttcctggaaatatctggttgtgtatcacttctgtctccatctctgcagcaattggtctcagcttcttagcccaatcttcatggcagaagagctgtaaatggggaaagcaacttcctcccaagaagcaaaatgcagtttgatatttcaaactgtcatttccttcatatatgttgattgcttgagtgaaaaactcaaaacattgagccatagcttgagttcatcacatgggaaataaaacttagtttctgtcaaagtctcactcactttcaaggccagaggagttttcaaagaggatgctgcaataagcctcacaagaacataggctttcttgtaaaccactcaatgggtaaatgttagttttgcagacccagagtagtcccttagtaaacccagccatttataatttccccaggatttaaaatctcaagctgtgagaattctcagttttcacttgtgacaggacagaatggaaagattccctctatgactactggttctatatatttcatgccactctgggctccagtttacattctaatttaacaattcagtgtgcaaaatttccttcttttaataccctacctatcactaggttgtagcttcaaataggccatcattatcaaagcttcttggtgaatccctttgaaaatattgttaagcagtcgccattctattttataaaatgtcaaatgattgtccatggatgcttactctgcccttgcaatgactaatctgtataatctgtagtcctatcaatgagctgtttttctcctcccgggccctgttgttgttcatcctatttccctccctggcaaatgtgacagttgtagctgttgttatttttctcaaatgagtttaaattgtgaattacatcagttcgtcacagccaaagcaaacctctttttaattgcagatctcaaatgtcccccctctaaattaaaataaaatgcacaaaatgctgccaactgtttttccgactcttccaaaatggagtatatccaaaatgctactgatggattgagccacattaagacatataaacatttaaaatcacttacaacttttttgctgttaggggaaaatgttcacattttagttgtgggggttgcctgtgaggatgaatgtgagtctgttgattgccatttgtgtccctttgaagtaaaaaagagttttgccaattttcaataattcaccatggagatttctgtgggtttgtagtcagatataagtggctgcattgcctttgagaaaggacattgaggatgtccattttaatagctgtgtaaccttgggcttgtcctttaacttctgtgaacttcatcatcatcattcatagactttgaatggcgatatatgccttgcagaatttggggaataattataaataatgaatgtaaagtacttgacttgaataggtgctcaacaatgaagctgttatcaagatccacagagtgacagcatccaaatgtcacacgataagcagacccctgagccttttgggtttcatgaaccaaaataatttcaaatatttttgtttttaaattaaatttagtttttaatatttgtatggattcagagggtacccgagcagttttgttatgtgggtatatttgttcagtggcaaagtctgggctcttagtgtacccatcacccaagcagtgaacattgtacccaatttcaatttttttttaatggaactgatataaagttgacaaaatttacttttattttcttaagtgaaggcaacaaagaagcaaagccaactaaattctcatcattcttgcaaaagaaagaaatttagcaacaacaacaaaaagggaaggacaaaatctgagaaaataatataaccctttaaattaaataaatgtagattcatgacaaaagttttaaatttttcatttcagcatgaacgaaaaaaaatcatccatattgttgagctgctgaatacccaggaaaggctggaacccatttctttgttcatgtgtttgtccaaatcctgtgtttctctccattgactcttgttttctgaatgaccaacatattagagccatatcttataagggaaatgggatgatggtgagcttctttttcccatggaggctaagtttaaattattttctttcagacgcaccctgccaggctctgttgctttctgatctattttcagtggctcttcatctgacctgaaaacatgcatgggtgcttgttcactgatgttcccatctgtacagatctgctcatagtctcagatttaacaagccttattttatcactttcattttcacttcctatttgcagaatatcacaagtgaactccctgaagattctataatctttggttttgtttactatttctttagaaatgatggtggccccagatatttgtttctcctctatggcttgaaatgatccatttcttaatttttaaggatgtaaatccttcaaagttggacatttggttcaacatatgtatcaagagccaaagaatgcattctgtaaccatatgtgattgtgttccataagaaaggaagactgaggaagaatgtcatattgttatagaattagaatttggaatttaaagttagacttataaacaatagaccaagaccttccgctttagactggaaaattgtctaaggaggaaaaagacctgccaacagtcacgtagatattagaccagggatagatgatgacgtgatttggctgtgtccctacccaaactcatcttgatttgtagtacccataatccccgtatgtcataggaggggccagatggagataattgcatcatgggggctgttttccccatcctgttcttgtgatagtgagttagttagcgagttagttctcacgagatctgatggttttataaggggcttttccccttttgcttggcacttcttcttgctgctgccacgtgaagaaggacgtgtttgcttccccttgattgtaacatatagtaagtttcctgaggcttccccaatcatgctgaactgtgagccaattaaacctctttcctttataaattacccagtctgggctatgtctttattactatgcagcatgagaatagactaatacagatgactatagaactatattgtgaaggatattatattactgattgagctgttacagaatgtttcctattctatcattacttaactagtaatgtgcttagggttttgggttatgacttatctatgatgtatgtgtgactgtcatgaaatttaaagacatgaaatgcttgtaaactgaaataataattataggacacagtcaagaagagaaatagccacagaggcataaatattccatttgtaccctgaacccaatttctggttagattttaagcatattcactccatggggagatagtacccagaaatggctgcttcagtgccaaaaatactagagtttgaaccctggctcaaaaaattattttttgtatgaacttcaacgattgcttaacctctttaagttttagtttctaatttctaaaatagcaatgccaacctcagaatttttttttacagaagctagtattgtgataataaacaagtagaatgtattcattcattgaagtaagattatatcttgaaggttactgctctgaataatgttttcattaacaagatattaacagagcttttgaaggtcaaagttaggtgatcatatatgacaaaattacagggaaaattacgttaaaatttgaacaaaatgaaatatgtggtgaagccgtatagcatggttcatggcatcatgtataatgatatatggtaataatggtatatgacagggatcaggaatctacaacctaagggcccactaccagtttgtgtaaataaagttttattggaacactgctatgcccatttatttacatattgtctataaatatgctgcttttgtgctacaacactagagttgaatagttgtgacagagattatatggcccacaaagtctaaagtacttacaatctggacttttgcagaaaatgtttgacaatttctggtatataatgatgctgatactatgggttctttttctctctcactgagaaagcagcacagcaccaagcatcctttatatttccttagcattgactgcagtgccttgctctgcattctgcacatgttaagcaatctacacattctatggtgtgctttgctgtcaatttcctataactttaataaaaataaattattacataggatagtgctatggtttgaatatttgtctcctccaaaattcatgttgaaatttaatccccaatgcggtatcattgagaagtaaggactttaagaagggattgggtcatgaaggtgttgccctcatgaatggattaatgtattcatgaattcatagattcatgcgttaatggattaatgaattattaagtgagtgggagtggtggctttataagatgaggaagagagatctgaggtagcacactcagctccctcaccatgtgatgccctacattgccttgggactctgcagagagtcccagctagcaagaaggcactcatcagatgccgtcccttgactccagacttctcagcctccatatctgtaagaaataaattcctttctttataaattacctaggtttaggtattctgttataagcaacaaaacaatgggtaagacagatagttaaggtggacaaagtatcttccagcatgggtgttgtgaagagctatttccattcctaaaatctggttcacgaaacacttatcctagcacagaccttttgggtttagttcagtgattctcaaacttgaacatacaacagaatttcctgctggtctggaaaaaacacatagttgggtccatccctagatatatgattcaatagaggcagtgtagggcctgagaatttgcatttgtagcaatttcccagtgatgctgatgctggtggttcatgaatcacctttggggacttccacatctggactgcgcagattgatagaatcgtaacctccacaaggggctagacatatgtaatttatgcatttaagtatatccagcttctatcacagggcctggcccatgtttacccagcactcaatacatatctgtcaagtggatgaataaaaagccactgcctgcttggctgccaacctggtaggtgagagacttggtttgaaagctctgcctttggttgtgccaatgactgggaaaaaatatctagaaacttaagaaaatctacatggaactccttgtggtatgctctgaaatacagactatagaggaaatattttagtggctctacaggatacatggtctctgttgcacctactgaattctgctaccatagcaagagagccaccatagaggatatgtaatgaatgggtatggttgtgctcaaagcaggcattgagccagattgtttgctgacttctctgttaaaccatgaattttaaatgattgcatagtatagatggtacatacatggacacatgtaccatcattgccctttaataaattttattgcattataatatacatatagagaattgtatttattgtctgttgcagtttgatgaattttgtcaactggatatatccgtgacagtacccagggtgtaattgccttttggtagatcggaattgtttctaatttgggacttttactaatgaagctattatgagcatagtacctgatatactttattttattactatatctgcacattggttgtattagttttctgttccttctataataaattaccatgtacttggtggcttcaataaatacaaatttattatcttacagttttgcaagtctgaaacctgggttaaagccaagatgttggcagggctgtggtcttttctggaggctgtcagggagaatctgtttccatgccttttccagcttctagaggacaccaacattccatggcttatggctctttttttccaacttcaaagccaataaccttgcttctctctgatcatgcttccatagtcacatctctctgaaccacaggaaaaattctttgattttaaggactcatgagattgaattggacctattggagaatccaagattttctaccctcgtcaagattcttaatataatcacacttgccttttgtctcataatgtatttacaggttctgaggactaaggtgtgaatatttgatgggcggggttggatattagtctgcctagcatgttggttatatgaattaatcaacgaagactactctagtttgtaggaaagctgagttccaagatttttgccaaatttgctttttcaaatttttggaacaataaaaaaatatgcagtagcataatcagttagctaacatagatgatctgaataatagataccctggtaatgaaaatatatattaaggtaccatttactctttcagtgtaatgaaacaaaacccagcctactcaggtagagcataagctgtatgctatgtagaactctaacagaagacattctttagattgctatctatctgttgaccaacacactctctgacaataactcctttatgtcctctcctttcacttgacaatctcttttgcactctttgccttgtcatcacacatcatttttcatgtgatcgtttgttggagactcatatacagatgctctgtctggtctctaatggggcaaaaacacacaggacagaaacacacagcctgggtgtattttctactctgagatcacaagcctgaacattgtcatctttttgaacatcttcccaagggatagtgcaaagggaaaaagggcagagtttctcaagtgtaagaactaatttcaaaaactgtgcaagggtctttagagagctgtcggttagagacccactccccaaccaagatcactctaaatggaaagacaatgaatggaagtgcattcagagaatgcagcctgaccttctggggtactaaggggccttgtaggagggatggctctagaaggtttagctgttcagtctaagacaaagaaaacccaaagtcggttagaggaaggggatagaagagctgtctttaaacatctaatgaagtataacatgaaaagggggtttatgctggttttggagaaagctaaagtagcaattttcaaacttcagttgttcatttgcatcgcttgggaagattctgaatgcagattcctagtctccgcttactgaaggttctgaaagggggtgggacataaagccaaattttgaacaaagtgccacagttgatactgatagaggtatttcaaagatgttatatatatatattcatcagatatttattgagcattttcaatatgacaggcactgttacaagagtgaggatatacaactgaataaaacatactagcttcctgtcctcaaggggcttatattctagagggggaaggtagacaatgaacaaatccattaagaaaatgtatagtatgtcagacagcgataagtgaaaagaaaaaaaaaaagcaggaaaaggagctaggaagtactggggagaggggtgaagctgatttttaaataagtgaacttaaagtaatttttttttttgagacagtctcactttgtcatccaggctggagtgccatgatgtgatctcagatcattgcagcattgacctcctgggcccaagtgatcctcccacctcagccccccaagtagctgggaacaggcatgcgccacgatgtctggctaatctttatagtttttatagagatggggtctcattttgttgcccaggctggtcttgaacctaagctcaagcactctgcctgtctcaacttcccaaagtgccaggattacagacgggagccaccacacccagccaattttttttttttttttttgagacaaaatcttattttgtcactctggctggagtacagcagcatgatcatagctcattgtagcttcaaactcctgggctcaagggattcccctgtctcagactcctgaggaactgagagtacaggcacacagcaccatgctgagctagtttttaattttttgtagaaatgaggtctcactatgttgcccaggctggtcttgaactcctgggctcaagcaatattctcacctcagcctcccaaaacactgggattatagtcataagccactgcatccagccagctaatttaaattaaggaactgaatgaaggaagggagagaataagatgtgtggtttctggaggaagagtgtcctatgcagagggatcagcaagcgcaaaataatttcaggagatgtgtgcttaaggagtggtaagatgccagtgtgacctcgcaaactgagcagggaggagttagctaggactatctgtgaggtgagatactctgtttattcaacagggacatgagggagggcagactcctttagaaaagcaattgatatatttattctaagaagaaagaacttcgagctctcttgggaagtttgcattcaagtgcattggtatgcctgttgtagggagaattcaaatatctggttggtggttgtttggtggttgaaccaagccactggtttgcaaacctggctgtgcctcataatcacctggggaggcagaggtgcacatttgctctaacagcatttttttttttttgtctttggctaattatctctccatgatttgaagtgttgatggtactgataattgaaatacctctctttccacggccaagaaacagagatataacccaagtcaagttagtcacattttttctattggaatttaatcaatttaatcttgactagagtgacacatgcatggataacagtaggggccaattcttttttactatgacttgtggagaagccatcttttaagttttgtttcccagactcccataactctcagttcttattctttccaaggtctgaattttaagcattttctttcattctgagagccacactataaacttccaaaatatttattttccccttaaataggcgagagttgttttttactgttctcacaacaacaaaaagacaggtctgatacagagattcacaaaaatacatatttccaggtatcactctgattccattgaataagatatttggggacaacattctaggatttagtattttgaaaggctttttaggtaatgctgattcagttctggtcctgcaaaatacaggctgaaaatcctggacttgatgcttcagacatatccctgccatgagctgcttgctgtgccttctggctgatttggataaaggcgctccaattctgaggctgattgtatttctctccttccctctagtagtcattctcctcccaaccgggttcattaactagtgaaaactgaagccaagtgaacaaattgtctggacctctatgttaagggccatgtgtagataagagtcaaaggaaggaatgtttgcaggaatccccactctgccggggtctggctttgggaggttgggtaacaatttcctgtaacttcacgtacttgtggagagcacactttccaattgtgtttcaggaaaacctatgttttctaagaaaggtacaagggggctattgtggtatatatgtatatgcttatttacttatttattttcagtttgttctatgccttctgcctcccaatgtgagtcccacaagggcagtgtcttagtctgttttcttttgctttaacagaataccacagactgggtaaattataaacaatggaggtttaatttggttcgaggttcttgaggctaggaagtccaaaagcatggtcctggcatctggtaagagtcatcccatggtggaaggtggagtgagcacacaagacagagagaggcaccaggggctgaacttactttaagaggtggggcccaatctcttattaagccccacctcttaacattgttgcattggagattaggttcccaacatgtgaattttggggagtcacattcaaaccatagcaggcagggaccttttcaattttgtttccctctgtatgctcagattctagaatagtttctagctcttaggaagctttcattaagtagttttagagtgaattaatttttaaaacatcagacctttacagaggttttaccaatggttctgttattaaatattattttgaaagcctctccactatagcagtattgttcaaacccagtgctacagacaagctacatcagaattacccaaggaacttaagatgtagtttcctgagatgttcctgaaggggttgtttcagtgagcctggagattcatatggtatgtttatgattattactattatgattgatgttattactgtagtgatggctgttttgaatttgcaaggtttaaatgcacttgactagatgattgccaaagtctctccctgcactgacatcctaacaggatggttctggtgagaaaaataagctcggacttcacctaagtggccctgaaattccttcctttcaaaatttggctctcttcacaaggagttgctatattgcctcagaggattttgcttccttgctttagggatggggaaaagaaatcccctgaaataatttcagggctttgggattaaaaaaaaaaaaaaggcaagcagaagggggcaacttcatattcctcttgggactctgggatttctccaagatagtaggagttcttgtttattaaaatgtcttaggtatgcttctcttttgtggcaggcactatcgattaggcagcaaagaaggtagacagattttctgctccacagagcttacagtcttgtggaggagacggatgttagataaacaatggcataaatagggatttaaataaccatcaagaccaattccttatttgggaatatagcagttgaaaaggtggaattaagtatttattcttagtggttcttatatgaactatattttaaaataaccaaaaagcccaaggtgatcaaggaaagtttagttttgtgtgtgaaaaaattcttaccaagaaaggagaaaggagtgatagaatccacaaatcactattttatttcccttaaataaataatgaatgcaggctacactcatcaatgaatggagccattaaaaggaaagtttgtggggaaattggcaatgaaggagttaggctattacattcctactgttacctagcatttattgtctcagtattctggaggccagaagtccaatatctggcagcactgtgctccctccagggattttaggggaaaattcgtttcttgcctcttctagattcttggttgctgccctagtgtttcttggcttgtggctacatcaccgcagtctctgtcttcatcttcataagacctctgtgtttctctttcaaactctctctgcctctgtcctgtgagaatacatatgattgcacatacaatccaccaagatatctagggtaaattcctcttcttaagatgctcaagtgaatcacatcttttgccatgtaaggtaatattcatatctgaggattgggatgtggacatatctttctgaggggcgccattcactccaccacatgtgtcttccagtgggatgcactgtgaagtacatagcctcatttgcaatctttccttgacagaaaagcttttctgtgtttaaccagaccgttggagcttataatcatttatagaaaatattggagatagagaaataaatgaaataatccaggcttagtggctagctcctgtaatcctagggctctaggaggccaaagcaggaggatcacttgaggccagcctgggcaaactagaaagacgcaatctctaaaaaatttaaatttaaatttaaaaaagagcaagagaaagtgaaatgactttctaatcaggtaaacacaaaatatggaatgttccataggataattgactttttttttgtgctaatcaatggcatggaacaaggtgaaagtgggctgttctagattacaagatttaaagacacagcaaccaagttttcttgtggaccctgtatgagtacttattagaccaaactagctctaaaaagacatctttgaaatgatagagtaatttgatttagaactgggtgtgagttggtacttaggaattggaatgaatttgattagcagtgacaataacattgtagttgtgtcaagtacttcttgtgtcctgtgtcacatcctctcagtccaccttttcaccccagctgttgcggctacccctagtgttgcccaggtaaagcctgatagcacctcccctaaacttcaccacatgcctttctttctcctctgggtgcctctgttcccctatgggacacctgtggtaactgttccagctattctgtctctttctgaagcattccattgccaatctgggagtgtaagagttaatgctccgtggggtgattcctgaccagtgggtaggagaatcagtggataaatacttcccattgtggtcactcaataaatgatctaaattgcattctacagctcctctgagagtcctcagcagaacccagccccatgtgcccacggaattagttctctgagaatgcataatgcatcatccttgggtaggctttccctccttccctgtttcagtcttctcagccccacactccttgggatcacttcccaaaataacaacttacatacaagcccctgtttccagctctacttttagggggacccaggctgagatagtgttttttttaaaaaaaaaactctcaggctgggtgtggtggctcatgcctgtaatctcagtactttgcgaggctgaggtgggtggatcaccttaggtcaggagttagagaaaagactggccaacatggtgaaaacttatctaaaaatacaaagattagccgggagtggtggtacatgcctgtagtcccagctgttcgggagactgagacaggagaatcacttgaacccaggaggcggaggttgcagtgagccaagattgcaccactgcactgcggcctggttccagcctgagtgacagagtgagactctcaaaaataataataataataataatttttaaaaaatagctgatttttttttttttttgagatggagtctcactcttgttgcccaggctggagtgcaatggtgcgacgttggctcaccacaacctccaccttccgggttcaagtgattatcctgcctcagcctcctgagtagctgggattacagatatgcgccaccatgcctggctaatttttgtatgtttagtagagacagggtttctccatgttggtcaggctggtctcgaactcctaacctcaggtgatctgcctgcctcggcctctcaaagtgcttggattacaggcgtgagccaccgcgactggtcagctgattatttttaagacatgcatattgaagtaattagacatgaaatggcatgatgcctgggttttgctttaagtatttcactaatatcaaagaagaaagagaagaaagagctagatgaaacaaatgtaaatttatgacgactgttgaatctgggtgttgagtacatgggagaatgttattgattattttataatttgctataacaaaacatttaaaaggttaaaagtattacaaggtctgtgaaatagaggaacagactactctgaaagtacatgctagaggacctagtctaggtgggagatcgaaaaagacttgtctgatgaaatggcttttaagctgtggctgaaaggatgaaatggatttttcagaccctttctcctaaggtacttaaggtaccttcgtgaatccggccatagttttagaattacttctgcactctcttgcttagaacataggatcctaagcctgccacccagggccttccagggctggctctctttactgcttttaaatggctcatttcccctgtattgagtatctgctctgggtggcaaatcattttgtgtgaaatatattcattcacctgtagacaccttaccatatctccaagtgactctttgaaatctgactatttcttttatttgttgtgaatgatagagaggaaataggagggctattttagggtggtccaaagttgaatgaactgcctggtaaatgtgactgaataactagcttccttgctatttgcgacatcagaatgcttagatctatttgatgccagcggactcaagccaggtcctctgtgctgtcatttttgtgctgtaaatgaagctgtggggagaaacatttcccctattagagcacattcatcctctatgcccaacagacgaaagaggatttcatagctgtatagctgactgggcgaggaaaatgcattttgcctataattcagtaaacaaccagtcaagtcagtcttttaaatttgatttgctttgtaatgccttatttacagcagttttctccactggtattgacatttaattcccaatgcttattgatacttacctttactatcatgcagtattaccttgcatgtttaacttgctttgtgtaccacaaagggctttcataaccatatctcatttagccctcatagcaaccttgtgatgttttttctttctttccttccctttcttttcctctactttttttctcccttcctcccatccatcttccttgcctcccactcgttcctcactgccttgccttctctccttttccatttccttttctttctttcctttcattccatcattcattattctttctgtccctgtctccttcctttgccccctcccttcctacctttcttaattgtagcaaatattttttaaagtttcgtttgcaagtttgatagcttgagttcaaatcctggttgtgtcattccctatctgtatgaccttaggtaagttacttgagctttaagcttgaatttgcccattcataaaatgagcatcataataatgcactttcacaatgcagtgagtgcttgtttgtttactgggttcagtctctggcagatggaaagcaatcaaaactgttttctattattgttattcccattacttattacactgttcagatacagcaatgactgtgaccaatgtaattaacaagcccatggagtttttaataggcctgtcaagaaaactgaggcatgcagctagtaagtggcagaaccaaggtttcaatttggaccttgttttcaaggtaagagccttcttcgctactctgcttaatgctttagacaaaaaattatcaataactcagagttctttttttctgtttttagaaagtagtctcaggatttgttataattctatgttgttattatacctatatatatgtgtatctaaaaagagttccctaattaccggatatgcagaacttgttactacacagttcaaattcttgcccttcaggagtttgatacctaagaaagaataattgagtcagttatatttttgtaattgaatataatttaaacctgtcttagctatctgcctattgtctgaaaaaaaatttgattcaaaataatgtttttccaagttttgcttatttaatataaggctatattggaaaaaatccataatttcacatgatggctacttgcctgtgacagatgactgcctcgtgccttcaataggaaaagtggatgagactatttagaattagagaatatcctgatgatttcataaattatggcaaccacgtagaatgattttaacctaaacctcttgttcagtaacagtgcttccactggcagcgtctcatcataacctgtgggttgtagggtgtgtgtcccattgccatgttggcactgtggtcgcactgtacaaatgaatatttatacatgccaatcactatatgcttaaaatttttatgcactcaccaactataacatagcagttaagaatgggtaacttataactgccaaaacctctgctttgccctttgctagttacatgaattttctgagcctcagtttctcatctgtaaaattaacaatgggtaatgacttcatggtgttattgcaaagaattaataagaagtgcacataaaacattttgtatagagtttggtatatacggaaaagttattattattcatctatttattcattttttgaatacctcatatatactggacgaaggccaaatgctggagatgcaaaggtgaatgataccctgtttagtttacgttcagagttcacaaaagatggtataaaaaatattttcagatagcaagtcaagattacggaaaaaagtgatcatcgctcaaagtttcccggttcacacagttgcagcaatatatgtcaattatatagtctgacaaggcatttaattttgccgtatgtatttcggtaactgatttcagatctgacagtttcctttaaggtgcagtgtctgatgcttccatttatttcaaagaattgtctttcaaacaatactctgcaaaagttgtatgttagaacattatcaagtaacctaatgcaattagagctcaccgttgctgatgtgatcaatgaaaacctctagcctttgactataacacggaataatttatagttaaactccactggatttttcacattagattccatgttattttagctgagtaggaactttacagagcctcaaggcgctcagaaaatataagcaattgaaaaaagaaaacagagaccgacagccttaccaaaaagcaatcaaatttgaaatttaacagaaacttggcagtcacatattgttatgacaccacttactatcaaatcagtactggccataaactgggtttgttaattattacagcctcttacttctgtgtggaggtcaaatggggaagaaaaaaaagatggtcataaactaaagactcagaagggcatatgccagtttcgctggaaaatatttgctggcttcagggcatagcagtgcacatcctcccaattaatagcgtctttccctcatcagcgatgccagtagaagaaggcacatgttctagtttctttgtttgcaaattagagaatattggaaaattatcctgtattttaaagatcaaaaccaaaatggcctggccaatctgggttgatgcttcagtttcttttttttttcttttcctttcttttagagacggggtctcactctttcacctaggctggagtgcactggtgtgtttatagctcactgcaacctccaactcctgggcacaaatgatccctcacttcagcctcccgagtagcttggactacaggcacatgcttggctatttttttttatttttatttttttgtagagccaggtgtcttgctttgcggccaaactggtctctaactcctggcctccggcactttggcctctcaaagtgctgggattaccggtatggccaccatgccaggcttcagtttcttcgaaatgaaaacagagtttaagtgaaatacaacatgagaaatttgaagtgaattcatctgataagccaagtaatttacagaaatgatccatgaagataatgtgcaatgaagaacagatgccaaattacactggatattttctgttttcagggataaacaatcagtggatctttttcccagtgctggtttgcttgtctccttgcttcctaacatcaccttcgttgcctgaatcctttcctccatcttaaatgaaccattttttcttttatccagctaatctgagcagtgtagtgccaatgtacatttccagactaattttccagctattccctttccactcattctgatttctggctttgtaggacttttacttcctctgatgaccttttaccgtgatcacactttgacactgaccatcactctctgctgtgcttatttttgctgtgtaataaagtcttactcattctcctccaagacccatttctaacattccctcctctatgaggccttgggtgctgtctacaggttacttgtcccttcgctgttcacattatcctacatttgttcatgtggtttgtgtctgcccaagtggactgtgaactccatgagagacagaacctaatctcattcacttttgtatttctgggacccggcacaggactggcacaaagtaggcgttttatagatgtttgctggatactgggctgctgtgtatgttggttagcatcttgcacaaagacatctagccaagggaaagggcactaaaatccagctcatgaccatatgtatcttggtcacgatacaaccctaaggaggggcacctctcttaaccctaaggaggggcacctgttttgtaatttctttacccagaagggcccctttatgcaatttccatagggacatagtatgtgctagtaactgaccttgttgaatggatgtataaagaaacaagtgaatgaagtttcccgtaatcctctacagctattaataatacaaaacaaataatcaaaaagacaaaagaagccttttcacaagactaaaatcatctagtccagttatcaaaactgatcaaattcggcactgctcaccttatatgctattcaacttctgtttgactaattctgtgaagaataaatcctcacatttgcatcttaggttggataattctcttggcagtggtatctgaatagtattattttgaatgcaagcattttttatgactatgattttttatattgggactgtctatctttctgtcctacacattagtgatacctcttggacattctgtagggatactgaaacgtgtctacaaatggttcatggtctattatgtaagcttctttgtgctcagttgtaaaaaaggatggtcctaaggtcttaattatatgagtcattacaattttaaaaaattcctaggtagaagtcaggctatttagttgatttaaaaatatttttgctagaatggatttcttctagcatgttgaaaatgctgaatcccatgttgtaacacctcaccagaaattatcagtagaccagaaggtaatgttgattatgatctcatttattcatccattcattcacacattcatttactaaaaaattacttacatttctccagtgcttaatgtaatgcttaacatatagtagacaatgaatttgtgttgacttgaatttattcatatatgcattctttcattctcttatcaatatttatggggctgctacctcaggccagacattatgtgatcagtgcagatacagcttcttggcctgtggaagcatcacgccaatccctgtcttcatgttcacatgttgttcacccagagtatgtctctggatccaaactgtatctgcattttctttatctgcgttgatcactaatgtagttccaggacttaacataatgcttaaaataattgatatattttatagttccctctctgaatgacagcaggctttatgaggcatttaatgagtgattgtcagtcctggctgcacattagaaccacctaaggtgcctcttaaaaataccaatacctggggcttaacccagaccaattaaatcaacatcagtgaaggtgagacccaggcatagctaatttttaaagctccccaggatattgtgagctccacccaacgttgacaattactgagttattctgtgccctttttttttatgtcactggttaatgtcacttctctgggttgaattatatccctccaagatttataggttgaagtcctaacccccagtacctcagaatgtaattaccttgtagaggtaatcaagttaaaataggacattagaaggagttctaacttatgtccttataaaaagaagttcggatccagagacacacacaggatgaatgccatgtggacacaaagacagatattggggtgatgctaccacaggccaaggaataccaaggcaaacccgcagaagccaggagagagggacggaacagagtcctccctcgaagtcttcagaaggaatcaacccttgcagtacacgtgtattttggacttgtagcctgcagaatgatcagaaaataaatttccttatttatttattttttttgtagagacagggttttaacatgttgcctaggcaggtcttgaactcttgagctcaagtgacctgccctcctcagcctcccaaagtgctgggattacactgcccctggccaatttctgtttttcgggctccctccacccccgaccatgtggcactttgttatagcagccctagtgaacagtacaatcagcgcctttataaatgcgttttttaaagagctaactttaaaatgttctgcttccttcagtccccattcccttctgaaaatggaccaactcccgtctctgagcccagaccagatgctatctctctacttcttccaaggtggccttatctttactaagagtcagtgttgaaacatgcatgaccagcccacctggagctagagacttacaggctgactccatgatgaataatcaatgtgcgataattccacttgccaagcaaagctcggcgtagacagcggctgcttctggcagatcgataaagtacttgaagacacttgtttcagtggctctttgaattccgcatcatcatttgatttgctccgataacattcaagtcttgcctctttaagttattgttttagcaaattcaatttacaattactttccatatgaaaagcttaagagattcagtttaatgccttattagctgtaaaatcaactgctgtttcaactacgcggtgtgaggagcagtgaaaaggcttcggttcttggcgaaactttccctctgggcttctgacgaggggcagcttcttcagttgtggagctatcttcacaatacctgctttctaagctcctagtcattggacccaaattcaaattacatttccctcccgtgtcagggatttctggggtaaaaataagctactttgaagacaggttgctctcagcagggattttttgctcatcaaatgtgatccatgcaacaggcacctttgaaaactcaccatgacgccgattttatttttaaatggagggactaaatggccattacagaaagtcggcctgagtggagtgggggttggggggagagagtttattactgttgtttgaatcatttataataatgtacttttgtgtctctggataactacatgttaggagtgaagaaaatcctcactacatgaaatataaaagaccttcttactatggtgtgcaaagtcctgtaagctctttccagcacctgctgcttggacctcctcttcagtcatgcacccctagttcattgtcctcctgctcgagtccttcctgcccccatgcgtagaagcctgatgccacctcatggcctttgtatctctcgatcgaatgctgttccctcacatatttgcctggctgtcatatcttcttctgattaaatgtcaccaaactagtaaagccttctttaatcatcttctccctccctgcccacctcagtcaccctctgttcctttatcttgttttgtttttatcacagtattcacctctttttgcgtgaaattattatttatttgtctgttttctaattgtcagtcttgcccctctctgccctcagatgtgagaatgtaaactttgtgggagaagggacctttgtcaatgttcacctctgtttttccagtgccaattgatgggcacaaggttggcattgaatgaatagttgtgggtgaataaatgacagaaacagtgtgctttacttagtgctgcataacacactacccacaaagtaagtagctaaaaacaaaaactatttatactttttctggatttcctgggtggcaggcagttctgctttctggcctgggtgggcttagctgggacaattagggtgcctggcttctctatctacatattatttcatgctaggcttcttcagacatggtggtctcagggtttaagaacatgagagctggcagggtgtggtggcttatgcctgtattcccagaaatttgggaggccgaggcaggcggatcacctgaggtcaggagttcgagactagcctgaccaacatggagaaaccctgtctctactaaaaatataaaattagccgtgcgtggtggcgcatgcctgtaatcccagctacttgggaggctgaggcaggagaatcgctggaacccgggaggcggaggttgccgtgagccaagactgcgacattgcactccagcctggacaacaagagagcagaagttgccagcatcttaagaaggcctaagctttgggacatacacaaagtcacttcttccagcttctgttggtcaagggaagccataaggccagaccaaattcaagcaagtagagaaatacatttggcctcttgagagtggtggcaatggatcatggggccaggaacaggattcattaggggttattactgttattatgtagtgatctgccccaagccccaagtgatatattttttgtgggaaagctcattctgacctacatatgagtggcaggttttggaacataagattcatatcttatatattcatatcccagacatttgcatttgtgccacctgtcataataccctgcacactataaacaataaatgcctccttggttttgctgttgctactgtacttacatcgctatatttaggataaattttcatgtttacacacacatcagtggatgtgcagggattatccaaagaccttagtacatcatttcaagaaaatgggagtgaattcgggaataaattatattgattttacttcagacatttaaatttgtttcatctattgcttttgctgtggaagaattgatttcaacaaggcagacagagaaaaaataaattggttttattgaattcacagtgacctgattaaaaaaatagtcattgcaagaaaaatgatcttacttcctattttattacagatttttttccttcaaaaatttattggtttaatatagtaagtgaagaagatgatgaattttatttagcattgtgcagaatggtttgggggctgttagaaaacacatttcttgaactatttcttattcagatgattgtaaagattattttgattaagaaggcacctctcgctgtttgatgcttttatactgaatgaaaaacagtccaaaggtctgtaagacaattcacattggtacagatttagatcattatttcctgaaaagaaatgttgaaatgttagttactactcaaattcttttcttaaaacaaaatgaaacattcgagtttgacttagaaaattactagactgcagaagggaatagagaagaaagcaaaaatcacctgatgtctttaaacttcaccttgagtgtttacaattcagaaataacattcaatgttcaattaaaatttgaatgtctctatttgtactcaggagatgaatagatttggatatactttctgataattccttcactgtccaaactgctgctacttactatctgaaatcaggaactaaatagatttgggaaaacacagagtcctttgttatctgaacttgctgtgcaaactcccaataactgagaactgatttggatagcaagagatacttggatataggttatctatactctttaatgacattggtaaccctctgatcccattgtctatactgtttgtaagttactcttttcactcgaaaatatactgtgaaaggaagattgcagctggggagcatagtttgtcaatctctctaaatccacacataaaaacagagcaactggacagcaaaaccctcatacaatgtttagcacaaaaccacgtcacaaggtctcttcacaaactccatatccactccatggggtgaaatgtgtgtaaacaagcaataaacatggtgtgataaatgctctgttctgagctcccttgagatgagatcagagtacagggagttccttaaagacttcgcggagcttcaaagagtatttacaaagaaaaacggcataatagcaacttaggggacaactttcacatgcacagttcttcattcagcattccccacatgcttcttatgtttagtttactcattcagacattttttcccttgtcaaactttgtttgcatggtcagtatagtactagttgtacatatctggtatgaagttttaagagttgctttttacttttgtaagatcaattatggatctttcaggagaatatgtgatcttgtagatatatcaaggtggattgtaaagactactgaatctaatccttagttaaagtcggattcattctttgtctactcaacgctgactttacttttaaacaatgtttttcaaccaagggcactatacacacaaataattgcaagttttaaatattatttgatgtttagatgcaaaaggagacaatggttaaacccattactcttatcctttagcccttgatatatttcatcttatgttagatagagtttaagagactactaactagttacaaaagcttgtattgtttctttattatagaagtaactcatgttaatttcagaaaaaaatatagaatacatattaagaatgggataaaagattacccaggattccaatttgttgttgttgttgtttagaaaccgggtcttgctctgtcgcctaggcaggagtgcagtggcatcttcttagctccctgcaacctcaaactcctgggctcaagtgatactctcgcgtcagcctcccaaagtgttgggattacatgcctggcctcattttccactttttgacagtgattgctattaatgttttagtatttatcttcttacagagtttttaatgcaaatgtattgttttaccaaaatgagatcatgatttatattctgttttttaacctttttctttttaaaatttcaataaataatgctctgcagctttgttttcaatgacttcatagtattttatcgtatggatgtaccataataaattcactgattatttattattgttaaatattttgattgtttccaaaatatcaaagttttttacttacgaggttgcagtgagccgagagtgcaccattgcattgcagcctggatgacaagagcaagactatgtctcataaaaaaaaataaaaaaaaaagttgtaataaaaagctgcacatttattttggctaatatgtccaattgcttagctaagagtaactaacagacatggaatttatggaaaaaaatgtacattttaatgttttcaatcagattaccaaaggcccttcaaactgtaacattttatctctaactagtagtatattatgatgctctttcattcatacctttacaagtaatgggctttttctcattgttattttaatttttgtttgcttaactattagtaaggtcgaacatttttgttagtttatatttattatatactagtaaaccaaaggaggagttaatagtaaatgaaaagagcttaattaaattaagccatggagagcttattgactggtccctcactcagcgatttagtatataaatagaagacttttaaaataaactttggcttacctatgttgaaataatatgctgctttgaaaaggaattcagtagccccctatgtactgaagaacaaaaaatgtatgagacacattgtcaagtgtcttaatacttaacataaaaaagtcacaaggtacaacttaaaaagtgcttttaaaattaaatttgtttacatacttgaaaagttaattttattatatattttatttacttattgaagtgaaaaatgtgcaaaaggttatctgtgatgactccctctcacctctaccccagtcatttcattcttttccctggagggtattaggttttgaggttttaaaaaacattcttttagtgatatttcatgcattttttataaaaatggattcatataatatacagtgttctggtccttgctttttttttcatttgacagtataactttcagaccttgccgtatctatttcctgacttgtttcttatggccccagaaaattcttttatatggatgcaacatttgctagtctcttggtaatgggtattacaattttctctgatcttttgctagtactaaaaaagaatgctgaaattaacatatatatgtatgcatatatatatgtatgcatataaaatttgaaaatggatttttaaaaatgtctgaaagttttaacaataaacaaggactacctccatgggagtggggagctggatgtgccaggtaagattttactgtttatttcatgcactgttttgatggtctaaatttttttattgaggttttagtactttgaattttttgaaaatgaattttttttcttgagatggagtctcgcttttttgcccaggctggagtgcagtggtgtgatcctggctcaccacaacctctgcctcctgggttcaagcaattctcctgcctgagcctcctgagtagctgggactgcaggcatgcaccactacaccaggttaatttttgtatttttagtagagacggggttccaccatgttggccaggctggtctcaaactcctggcttcaggtgatccatctgcctcggcttcccaaagtgctgggattataggtgtgagccaccacatccaacctgaattttaaaattataaattagtacagccattatggaaaaagagtatggaggttcctcaaataattaaaaatagatctaccagatgatccagcaatctcctacttggtatatatccaaaggaaatgaaatcagtctgtcgaagagatatctgtattcacatgttcactgcagcactattcataatagctgagatatggaatcatccaagtgttcatcaatagatgaatggataaagaaaacatgtacaaaatggaatactattcagccttaaaaagggagggaaatcctgtcattggtgacaacagcgatgaacttggaggacatcatgttaagtaaaattagccaagcacagaaagacaaatactgcataatctcactcatgtgtggaatccaaacagttgacctcatagaaggagagagtaaaatagtagttaccaggggtcaggaggttgggtgggaagatgttggtcaaaggtcacaaaatttcagttagacaggaggaatgaattcaagtgatctattgtactcactaaaagaatagattttaagtgttctcaccacaaagaatgataagtgtgtgaggggttgcatgtgttaattagctcaatttagccattccagaatgtatacatatttcaagcatcatattgtacacaataaatatatgcaattttttgtcaactaaaattttttaaaaaatcaatagattgaaaaattagtgttttagattcagaattatgatgtggacagataaatacctttgggaagctggcactggaaagaattttgatggaatgttgcccactgctaaaaccagttttccctcctctgggtggtgctggtgctggtgatgatgcagataaatgtattaggtcattgagaaaagaggagtttttgtcctttagattctgagtcctaaaaggaataaagctgaaaacttgattctgttcttttgactttcaaattcctcagctgaaagccaagataactgaaaactggtgggcaaggagttctatagctgaaggaattatatacatgtagacatttaatatccctctaacacaccatctagaggcatatttgtaagtccacaagtaatcatttcctgtgaaaataaagattaatatgtttaaaataatttatctcattacatgttgacatcagactttttactggctcttaatatttcacattgtaatgcttgatcaggttgaatattgaacattagcaagtgtagaaacatttatgaaaaatgacataatttattttgtgaaaccaattccaaatacatgaaaacatggggttagaattaattcatcaagaatatcaataagctgataaagcagagtcattttcatttccatcataatctttaagctatattcacagaaaaattacttattaaagcagccatatgtgtgattaatgggttggtagtggtactaattactcattagaatgcaaggactaaaataccctaggactcaaaaaaacataatgattttttattcaaagggttggctgggtcccaaagtctcaatggatttgtattttgagctataagaacatggttttgatctaaaatgagggagaaattattttaggaaggtcttacttggtactaacatagtgaaacccttctttttcatatgcttattcaatcaaaagttcccactttgagatcaataaccaggttacgatttgcctacatgcgttttcaaagttaaaacattgggatatgtatgcttttcttttctttttcgttttttgagacagggtctcactcagttactgaggctggagtgcagtggtatgatcatagctcattgcagcctctaactcctgggctccggcgattctcccacctctgcctctggagtagctaggactacaggtgcatgtcaccatgcccctgttttttcttttgaatgcttgatcatctatggacaaacatttctccatttcccatgagtaattgtatgggtgctgttttacaatggtggcctatgtgactgtttaaataataaccaaattttaaaattcataaattcaattgagcatcaaattagcagcattaatcattattagaatataagtagtgcatgcaagtatttcttacatattaaaaatattttctccatcattatcactgaacactgcagcttggagtgaggatagagattaggtagaataaaacctgctattaagtaaagatgcatcttctgaaacaaatcttaaaaataagaaacaattctaaggaagtcagattattttatgttttggatatcccaatcacgttaaaattctgagtatcaactacaattttcacatgagtaacaccactaatttttataagctaaaatgacaacaagaaactctaccccacgaaatattttcattttaattaagcaccgtagagatttgctgtgaatcacagtggtgtttgcttttgacactggagatggaaaggagatctcaatgctttatttttcatcaaaaaataaaaaagtcaagaaggattctaaatatatcaaagaatagctttaaaacattaaaacaccaaggtaacattttgagatgtgagagaatattatcttgtgagtggtgaatctagggaagcttttgtctgtgtaggaaaaagagggtttagcaattctacaacttccttttttcttggggataggagggaagtgtggcaaaagtgccatcaccaacaagcaagtaagaaatagcagaatgatgtgaagcaactataggcattaacttggatgctttgctgcccataaatctcactcaatgtatacttttaaataagattatttaacacaacagttgaatgtgtagcaagccacagttcattctctcaaataggttccttataattttatttatctattttattttacttgtatattggaccagttggactaaaataatatatccttctatagggacagtgggtcaagatttcgttagtaatggaaaactcaaacaatccttcttacacaagaatgtcaacccaaaagacccgctgaaacacctattggttatgcaaaactaaatttgttaaacctactgcagtaacagagaacacaccttaccaaagtcttggtagcatatgaaaataagaaattagatgaggatatgtataggtgtttagagtgtgggctgtgcaattttagggtgagtcttgctaaagaggacactggctgtgatggggcggagtccatgacagaggaggtctgggctggtggatgctgtgaggtgaaaagtgggaaagcagccacagtgagcaagatgttagtcttgctaagtaagcggtcttagtttatgctcttatcttccaggagcaagcctctaagttattttttgttttttcttggtattgtttaatgtagggaaagtatgcccctccccagaattgtttaacttggggtcaggcaaggatgttggtctcagtgttctttaacagggtgagaaggaattatgtggatgcccgtccgcctgtaaggtaccccccagagaaatctgcctgttagtattcatggccttatgtaatcctctccctttgagtgtgggctgggtttactggcttctcatgaatagaataggaaaaaaaaaatagactgtcacttctgagattaggttacaaaaaaccatgactttggccgggcgcggtggatcatgcctgtaatcccaggactttgggaggccaaggcgggtggatcacgaggtcaggagatcgagaccgtcctggccaacatgctgaaacaccgtctctactaaaaacacaaaaattagctgggcgtggtggtgggtgcctgtaatcccagctacttgggaggctgaggcaggagaatcccttgaacaggggaggcagagcttgcagtgagcagagatcaccccactgcactccagcctggcaacagagagagactctgtctgaaaaaaaaaaaccaaaaaagaaacaacaaaaaaaaagaccatgacttctgctttgctgcttcctccctctctctcctgttgctcttgctctgggggaaagaggccatgagtggctccatggagaggtccatgtggcaagaaactgtctctagccaacagataccaagaacacaaagcctgccaacaaccatgtgagagagcttggtcacagatccttccccagtcaagggatgagatgattgaaggcaggcaagagactcagagagagagactcacatgagccgtgcctgaattcttaagccttagaaactgtgcaatgtcaataaagaaaaatcatgagacaagtctcattcattttaggaggtttatttgccaaagttaaggaagcacatccaagagacaggtctatgcctttctctgaagatgattttgagggctccacatttaaaggggaaagggcgggatattgagaagtacacaattttcatgtaagagaggtttgaggaaaaatatgcattcatgccattgtctggctcagtgaatctgcattttttttacataagatgacatagacaaatggggcagaggagaaatgcagggaatctgcatttttacataagataacacagacaaaataggacaggggaacaatcagatatgcatttgtgtcaagtgggcccggggggtgactgcacttgtaaagataagctatcagtttacattgggtgaaatgtaaaattcacccaatgtgaaatatgaaatgccatggtgaaattttaacagaaacactttggggtaaagatctgggagctcactaggaatttccttgtggacaaaatctggggaggtgtatagcttttttcatcttgtagccatcttatttaggaagcaaaaaaagtgggaggcaggtttgcatgacccagttcccagcttaacttttccctttggcttcaccagtttggggtcccaagatttaatttgctttcacggcgatgatagtatttgttattttaatttactatgtttctggataatgtgttatacagcaatatataactaatgcatgttgatgtcatgttttcaggatgcataaatatactttctactgaaatttttacttatttcagaataagcagatttattgtccaaaatattggttaatttactatttttgcatcgaaacttgagagacatacttcatatgtttattatgaacatttcttcattctgctctatagaaactggccatatttgaagccgatagtgactattctgtggagagatagctgaagggaatgatgtagaattaatgcttccctgaggaacacactggattaggaccttggaaagagctactctgtaacctacggagcatttctctgcagctttgtctctttggcacatggcaggcctgaagtctacttgagaagaacagatataaacccaacatctgtatcagatgcactttcccagccttggcctcaaagaaggatttctggactctctgttacagtgagtcctgactctccctactgcccgtggttgctcttcctatcacccaatgtctgctgcttaagggagtagttttcttctcccatcaccaacctagggaaattcagttcttgggaggcaaacacaatttccctaagactttatcattgtttaaatttgaaagaaagaaatatcaatggtgttctgaaaaatttaaaaagggatgtatggttactaattggggctaggaaaactggagtgcaaactcagagagatacagcttccttgcttataggggtaattgtgaatggatgattgccagcattgtcctggaaaatttcaagatatatagagtttctctgagccactgttaacaagctaataaattcaactgtttctggtggaggtgagaaagagacaaggacagccaaaatactttcgggttctgcatgtttcccagttggctttggccttagatttggatttgcatagagcagaagctaaattccatttcttccatatagtcaacttattttgggccatacatatctacttcgattgtctgctttttggttactgaattttataagctctcctccattactatttttctttcctggtctaccaacttttgtgcccattagttactcatctgcgctccccgccccacccccgctcaagttttgcgacatctctgaacatgttgaacagggaaaaagaaattggttgactatctatagataaatatgcatagagcgggtgctgtgcaaataactttgccatggattaacccatctgccctcaccatagccacatccttcaggatagactcatcttaccgtcaccccgataagctgtgtgccttggtttttctagtctctgagccttatttcccttatctgcagtttcttctgccaacttgaaagcataacaaatctgcaattcacactgagagtctttccaagtcattgctaaagtctttatttatcaaagccagtatttttcccaccctgtttatattttctaacttttaatagtctttactcacaaatgggtctcaacgtctattcacgtaggctgttgctaagttggctgcaaaattggcttcagaaaagcttcaagggccccaaatgtctgcattcccatattgttctgtttgtagctgaagcatcaaaggcctctgtctgaatcattagaaggcaaagatagtgagcctttactagcctacagcctggtgtagatgactctcccgggtaatccagaaaatctaaccaattttctgggaagctggattcaagatgaggggattcaagggggcagagtgtacttagaacctcggatatggaataggcaaagcattgtgaatgaaggttggcaatggaaggcaccaaggtaagtcagagttctaatcaaaaggccacacaagagtgcaatggttcccaaatgaactgtacgttgaaatcacctgggaatcttttaaacaatactgaaggttgcttctattccagacattctgatttaattttctggagtgtgacctggcataattatttttaaaaattcatcagttctaatgtacagaaaaatttgagaaccaatggagtaatggttaaaggcttgcactttgaatctagacagatcttagtttcaatcccggctttaccactaatccacatgactttgggcaagttatttgacccctctgagctccaggtctttttgcaaatcagagataaaaatagtacctggcacttagggttattattaataatactaaatatatgcttagcacagtgcctagcacacagtaagtactcagaagacactaaccaatattatttaatactagtaccagagtttcaatgttagaagaaggcttgacagtggtcaaggtatacttaataaccaagacaccatggggtggagaaaaacatagcttctcactagccctgcctccagcaatcaggcagtgggaataatagagaaagcttgtgtgtgtgtgtgtgtgtgtgtgtgtgtgtgtgtgtgtgttactccccagggattctgccttgcaggatctcatcaatcaacccatttgacttattaccattatgtataattttgaggtttgtgtcaaaggaacaggtttgtcgtggttgctctaattatggggaaatcatgtgtaatacatattacacatgtatttttatggcaggtcttttacgaaacaggcttagtttctaataattttacaaaggaagatgggggtggtttaaagcttaactggaacaattttaaatgcatgttggactgaagacttatggattcagatgtttcaaatctgtgttgaaaactgctgagaatatactcagaatcttcaggatttaattcacacatagatgtgtatattttacattcacattatcctttattttatttttaactagagttaagcataattttacagatattcatattgttagcagatggctgcattcacactaataaacagcattttaaaatttaattttttttgagataattgtgattatctcaaaatacagattcatatgcagttggaagaaatatcacataccctttacctaacatatttcaaaactatatagtacaatatcacaaccgggatttggatattgatacagtcaaagacaacatttctgtcacttcagtgttcttcatgttgaccttttatagccatgccaacctcccttccaccccctccttaacccctggcaaacattaaattttttgttttccgtttctataattttgtcattttcagaatattctataaatggaatcatatagtaactaaccttttgtgattgacttttatcatcatgcataatttggtatctaggtaatactagcttcataaaatgaattgggatatattctctactcttctattttctggaagagattttgtatagactcagtgtaaattcttctttaaacatatggtagaattctccaatgtaatgatctaggcctggagatttctttttcttggagttttaaaattacaattcaattttcataatagctttatggctattcaaatgatctacttcatattggatattgggtgagttgtgggagtttatgttttttttaagaacgtgtccattttatataaattgtcaaatttatgtgtgtagagttgttcatagagttttcttattatgcttttgatgtctgcaggatctgtagtgatatcccctattttgttcttgatactggtaattggtgtcttctctctctctctctctctgtctctgtctctttttggtcagtcttattaaggtttgtcaatcatatcgatcctttgaaagaaccaggtttttgtttcattgattttcttcattgttagcttgttttcaatttcattaattgctgctttcatctttcttatttctttcctcctatttgctttgtatttattttgctctttcttggttgttgaggtaggagcttagattcgggatgagcatttcctctctctaatgcttgcatttaatgctttaaacttcccactcagtatgtctttagctgtgtcccacacattttgatatgttgtattttcattttcatttagttcaatgtattttttaaacttccctgagacttcctctttacacatgaattatttggaattgtgttgtttagcttccaactgcttagggattttcctgttatctttctgttattaacttctagtttgatttcactgtggttggaaaacattctgtatgctttcaatttttttttaatttgttgatgtttgttgaatggctgaggatatggtccatttttgtatacgttttgtagatacttgaaaagattatgtattctgctcttgttaggtggagtgttctgtaaatgttgattagattctgtttgttgatggtgttgttgagttctatatcccagctgattttttacctagttgtcctatcaactgttgaagaagagtattaaactttgtaacagtaattgtcgatttgtctgtttgccctttcattccaattagtttttgcatctcatattttgcaattttgtttggtacatacttatttaggattgctatcatttggcagattgacacttttgtcattatgtaatgtccatccctgtctttggtaattttttttgtgtgctgatgtctatgttatatgatataatgcagtgactcctgcattctttaaacacttgagatataattcatgtaccataaaattcctcttttaaaagtatgcagttcaatagttttaatatatttacaaagttatacaacaatgaccactgtctaattccgtgatgttttcatcacttcccttcaaaatatatccgctattagtcatatcccatttacccatttctctagcccctggcaaccactaatttgttttcttcctctatcgtttgcttattataggtatttcatataaatggaattatacaacagtatccttctgtgtctggcttctttaacttagtacaatgttttcaagattcatttatgtaattagcatgaattaatacttccttccttcttatgattgaataatattccattgtatgaatacagcatcttttgcttgttaatttaccagtcgatgagcttttggattgattctattttttaactatttttaataatgtttttatgaacatttggatatagagataggttttcaattcttttggatatataaccaggtgtggaattgctgggtaattctgtttaattgcttgagaaagtgttaaacatttttttttttttttgagatggagtcttgctcttgtcacccacactggaatgcagtggcacgatctcggctcactgcacctccgcctcctgggtctcctgggttcaagccattctcctgcctcagcctcctcagtagctgggattacaggcacccaccaccacgcccagctaatttttgtatttttttagtaaagatggggtttcaccacgttggccaggctggtctcgaactcctaactttgtggtctgcccgccttggcctcccaaagtgctgggattataggcgtgagccactgcacccagactaaactttttttttaagtggctacaccattttacctttcattgtatgaggattccaatttcttcacatcctgccaatactttttattgtcggtccttttgatacacgctttcgtagtgggtataaaatggtaccttattgtggcttcgattttcatttcccgagcatcttttcatgtacatattggttatttgtataaatttctatctagcacttttgcccatttttaaattggtgttgtctttatattattaatttataagagttcattatatactctggatattagacctttatcaggtatatgatttgcaaatattttcttccattctgtgggttgtcttttcactttcttggtactgttctttgaagcacaataatttccaattttgatgtattccaacttacctattttctctttcattgctgtcatatctaagaaacgattgcctaatttaaggtcatgaagtttttcacctatgttttcttttaagagttctatagttttagctctcatatttacatcctgatccatttagaggtttttttttaatataaggtgtgagttacagtgtccaatttcatttctgtgaatacatttcttttgattaatgcttccatgacatatatttttctgtatttttactttaacctacctatcttgttatatttaatgcaaatttcttgtagacagcatggattctattcctttatttgctgtatttagaccatttacatttaatgaaattgttgatatgttagggcttaagcctgccattttattttctgttttccgtttattctgtctgatttttctgatttcattttgtttctctggtttgtttttctttctgtcatcctgtgggttgcttgaacattttctagatttcattttctagaatttggtttatctatagtgtatccttttattttttgagtcagagtctcactctgtcactcaggctggagtggagtggcatgatctcagctcaccgcaacctctgcctcctgggttcaagtgattcttaagcctcagcctcctgagtagctgggattacaggcatgtgccaccacacctagctaatttttttgtatttttagtagagacagggtttcaccatgttgataaggctggtcttgaactcctgaccttaagtgatccacccaccttggcctccgaaagtgctgagattacaggcgtgagccactgcgcctggcctatctatagtgtttctgaggatatctctttttatagtgttttagtgattgctctatgtattatatgtacacagcctagcatagtctactgatgtcattttaccagtttgaataaattatagaaaatttgtctttctttatttttattttgttttctttatttttatttatttatttatttttttatgttgcccaggttgatctcaaactcctagactcaagtgatcctcccaccttggcctcccaaaagtattgtgattaaggcttgagtcactgctcccagccaagtttctttaccctttctcttttataattgttttaaatattttctgtgcacacatttaatatcacatcagataatgttataatttttgttgcacttatcaaatgtaaatgagaaaattggagaggagaaggaaagtctatttatttatctgtatttttgtttgccatactcttttttcctgcttgatattctacagttcctgcttttgtcatttcctttctgtttagaggacttcctttaatctttcttctagggtagggatgctagagacaaattctcttagttttcttttatctgagaaatgtcttaatttctcctttatttatggaggacattttctctggatataaagttctggtttggcacttctttttttccacacttaaaagacgttgtgagaattccttttggcctccattgttgctgatgagaatgccactgtcatttggattgtttttgtcttataggtgtcatttgttttttgctgctttcaagataattactttgtctttagttttcagaagtatgactatgaagtttcttggtattttggactgaattatctccaccaccactgctcctccccctcaaatctatatgttgaagcccaaatcccccaatatgattgaatttggagataggacctttaaggagataattaaggctaaatgagctcataagagtggggccccaatactatagaactaatgtcctttcaagaaggggaagaaacaccagatctttctccctttctctctgtctgtggatgtagaggaaaggccatgtgaggacacagtgagaaggtaccatctgcaaaccaggaagaaaggcctcaccaggaacctaccctgccagctcattgatcttggacttgtgaaccccaaaaatctgagacagctttcagcgaatttagaaaatttattttgccaaggttgaggatgcactctactgacacagcctcaggaggtcctgatgacatgggccaaagatggtcagagcacagtctgattttacacattctagggagacatgtgacatcaatcaacataagcaagatgaacactggttcagtctggaaaggtggaacaactcgaagcaaaggtgggaagagtagaagaggggagggggcttccaggtcataggtagataagagacaaattgttgccttcttttgagtttccgattagcctctccaaaggaggcaattagatatgcatttatctcagtgagcagtggagtgacttagaatagaaagggaggcaggtttgccctaagcagttcccagcttgagttttcccttcagcttagtgattttggggccccaagatttattttcctttcttttagcatctggactgtaagaaaataagtttctgttggtgaagccatctagtccgtgatattctgtaatggcagcctgagtagactaatatacttggtgtaaatttttttgagtttatcttgtttgtggtttgctaaccttgattctgtaggtttatgtcttttgcctaattaggaagtttttggtaattatttcttcagatgctttttcagctctgccctctttttcctctcctcctgggactccaatgacgtgaaggttgactctttggttgtagtcccatgacttcctgaagctctatttatttatttgtgtaatctatattcttttatttagattgggtaatttctattgctttatcttccagttgactgttctttcatctgttctacccattctaattttgagcccatgcgttgaggttttttaattttggttaatgtatttttcaaatctataatttacgtattgctgttcttcatattttctatttctttggagagactttctatttctttgctaaaatgatgttttttcatttgttttaagagtgttcttaattgcttgttaaagcatttttgtggaggctgctttaaaagtttttgtcagttaattctaacatctatgtcaagtttcgtgttggcagctatacattttttaaatttaatttgagatctttccagttcttcatatgatgcatgcttttttattgaaatatgggcattttgggttttatgaagactctggatgttatgtaaactttctgttttagctggcttcctctgatgctagtgggcaaagcaagagttctagctcgccagtggccttatattatgaaaggatgagggactttactgccctgtgggatacaagtcttgccttccagctcttccttcctacacagcagagtgctttgttgtgctttgttaaacagcctctcaggagagaagcctgggcacctcagtcagccttggctgctgtggctcaggaaggggccacagttatttctgtggtatgtggctggagtagaccagttattttctaaaagctttccccttgctgggcagcccatttgctagcctttagctgaagagcagaatttgtggggatacttttgtctgtgcctattagcatttctggatttctggcttcttcagtggcaagtctgaaatatgtgaagtgaaaaagcaaagacccaaaaccccaaaccaaacaaacccagggaacgttccactatgttgttctttgggggttaagttgcctagctcatctgtcttccctctacctttcagactctcctaatgtttgttttatgtataatgcccagggtttgtagttctacttagcaggtggaataggaaaaagtatgtctacatcttccctgatgtggaagtcccctgaattctatcatttaactgctcatgattttgcaattattccaatgtggattttggctgttctagatttgacacagacagtttttcttttcacatgcacatcacctgagccaagagagcaccctaggccacgtgtcaaacaccctgtggcaataagttaacattgtcaagtctccctaatgaagcatgttgacaaatatgttatacatacaattcggtgctggctttatatttctgcatttatatctatgcatattatatagttttatatactgagtagctttttaacatactaccagccacctaattaaaacctttctggggtttttaaaaagctgtagaaaaagcagaaattagcactctaaaaatggtttattttatagccaaatgtcaactaattattcccataggttgaaaattcttgctcattttaactagggttatgttcattttcagaggaaaaaaatccccctctgtcaaaacatgaacccccctcccccacaacctctttgttataaaaagttaagtgtttcctcatctggattttactatcatagtcttataaatgaccagattattaagcatagccttcctgggtatgttcatgaaaatgaagattatagttttcagtcaatgggcaactccttatgaatctgtggatgtttgatgtacaagcccctgcctggggctgatgatacagtgagcagggtcttactgagagtcacctgactcagcatctccttccaaccaccgccttttcattcactgatattgtgtccagagcatgctcagttttcctgtctttcactgttcttagctcagttggttacatcttagggaatccctttcttatttgtgctctcgcctttaatttaatcccggtccacaactctttcccttccaaatgcttcaaaaatctcagaatcatagttgcttcttatacaagtatgaggcaaagacctggagaaaatcaaatgtgattttgctaaaatatgtatattaatagtggaaagagagaataagatctcttgttctctaacaaaaaaaggtattcctgtctttgttacatttctgtaactctctctttctctctttgttatatttctgtaatctccctgggggcaaggaagggaaaaataaaacaccactaacaatgggtgattaatggcaggaataaacccaaatcaaacaaaaaagccatgcatagacaagtgaagtttgataaatagccagtgtcctctaatgtgaatcctttttgacatttctggaatacaacccacctggtatcaagctgaagaggaactgagtaggttctccttggtattctcatagaaaaaggtgaaaacatatactattagttgatatttgttgtaaaacaaatgaagtcttttattctggttgaaagtgatggaaagacaataaaaaaatcctgaaacataaagggaaaatttttggctcatgtatttatgaaacaagcttgaggcacaggtggatctaggtgttaaaaagttgaagtcaggaattcattttttatattgcttagctttgccatcctgtattggtttaatttccaagtaggcttgtcattaaaaaaaaaaatgtaagcagcacgaggtttgtgtcttacaaaattagagacccttggggaattaagatattttccccaatagtttcagtaaaagtcatgcacattggctgtgactagaactgctagtgttatatgcacatcttttgacttcctctaattttctgacttcttgacctctgttatggagtcagttctatttaaacataaactgaaagtaggaaaggaattactctcctcctctgcccaccaaaattgaaattctatcagcagaagaagagcaaaggatgccagaaggttaaatcaacatgtatctactacccacagagaagatagtaatgtggatacataatgaggtcagggagaattaatcccatgaacaccaaggctatccttgctattgttggtttaggtatctcttctgaactaggggtaggatcctcaaggttccagttattcttaaaatctgttttagaatctttctaaaagtctttatctatcttgtcctttttaattaaaaggcatgagttttcaagatgcattttaaaaagaaacttttattcaatgttatttcttctgctttgtttaacctgtaccaacaaggcaatatgaaccgtatttgtggatatgctttactctagcaaagttacaggctacataagtttggggactagactggaaacttaaccacattttaaaaccattttttcatggaaaaaaaatttcaaatggtaataggatcctccgagccatgtgcaggatataatctcctggtgtgccgtttgttaagcccattggaaaagcgcagtattagggtgggagcaacccgattttccaggtgccatctgtcacccctttctttgactaggaaagggaattccctgaccccttgcttttcccaggcgaggtgatgcctcgctctgcttcggctcacccacagtgtgctgcactcactgtcctgcacccactgtccggcactccccattgagatgaacccggtacctcagttggaaatgcagaaatcacctgtcttctgcgtcgctcatgctgggagctgtagactggagctgttcctatttggccatcttggctccaccctccttttcatttaaggaaatcttgttgctctgtgattcctcacccatcagatccatagccttcataggttaggaatgggcaagtatcacccagaagaaagagatcattgttgattgagtgttgggtttgggatggggccaaagaatttgcattctaacatatttttctaacatgctgatgtttagagcactttgaaagcaacctagagagataatagtcttgaaagtcaagtttactgagatagaacaaagatttataaattttagagtttccatttccatatcaataccaaaacctggagttctaaaactggttttaccataaatagatgtaagtaggccttgccagacaggacaaaaaatcctgctgctactggacagaggtggggaaggagacaaaatgactaagaaaagatagaatgttcttactcctagccaggtgcagtggcttatgcctgtaatcccagtactttgggaggccaaggtgggctgatcacttgaggccaggagtttgagaccatcctggccaacataatgaaaccctgtctctactaaaaatacaaaaattagccaggcttggtggtgtgtttctgtagtcccagctactcagggggctgaggcaggagaattgcttgaaccaggaggaggaggttgcagtgagctgaagattgtgctattgcactccagcctggaccacagactgatactgtctaaaaaaaaaactaaataaaataaataaataaataatgttcttactgcctttcccctaacaccatcttagagtctagtgtaaatcattggaagtagcaattagtggttaatttggagaaattaaggcctagccaaagatggggcccatattcttgcctagcttggtttaggcctctcaggaagctctgtgccatcatgaggtgattgcagaactcgccatggtggatggcatccaggggcaagaaaggggtctgagacatggctcttctttttctgtatggcttgtgcatgatgttgaataaatctagaagttcctatgagactctggtggctgagtgaggggatgcaaaggtagccaagaataaagagctggagagtactccagggagtggacacagcacagtgcacggatctgtagaaccaggcagattttgccacttggtagacacgcagagggtcagcagctctcaaaagacaaggagggagactgtccatagggaagaagctgagttccccaggagcgggcttagtattgcccacatggagacaacaggccaaccgcacacacttgagcacagaatgcagtgcatgagggctaggagagagaagcaacaacacaccgggagattgctgggagcttgcagagaatgtcaacaccagaagcagacagctctttcattccttgggcttagagccattcagggaaaatgagggtaaaactggcaggactgagcacccaaccccaaagctcttggtttacctgaatgtgactgttctaaattgggcaagcagaagtgtgtcttttcacaacaactcatcagaatgggagcgccaaagaaaaaggagggcagataaagaaaacaacagtattctgggagaaggggcggtggtgctagggattacattttaaccctgtcatgttatttccaggacagatataattcagaggtaactcaacatgttataaataatgtgattttcatatatttgtttaaaatgccacactcttgtaatcttcaccttttatttagttccaaaatttcaacaaatgaccctgaagagctctctattgatactttgggccaagatcttgctagacactggaatcttaggtggcttccaccatggctgggatctaagctggggcctaggcactgctgaccattaggccttgggcatttctggagaatttctggtgaactggtgacgggggctaagggaaatctgcctgaggggtctaaggaaccacctgagggggagttcgtcttacggaaggaaagcaggcagtctgcaaatgtccctttcacaaagctgtggttgtcgagggaggagaagggatggtgtagtgaatgatattctaatttattcctagtctggctcttggatgtatctctttattttcaggtacagtctcaaaaaactctttaaatgctgttgtacattggggcccaacagcgctgctttcaggcttttgttctaagcagaaggacaggcgttcttcttgctttgtcgctgaatactgagatctttgccttcttgatgggtggggtggccatggagaatgctggctttcagaggagaaattagatagagtctgatgtcccatttggccgggcagcatagccacagagcctggtagatcacagttatttgggagcccacttgaagtacccgataaggacttctaaggacttccaaaaaatgtgacaggccttctgtgaagtacaaatggccctaaatgaacaggtgagggcaaaatgaaaatttagtcaccaccctgagaatcactaattcaaacattttatttagaataatctttttttttttttaaaggattttagtacttcaaaggctggaaaactgcctttttatcaaggctagacttgcaaggcccagtgcaaactgaaaacacagcgtccatgtttagaaactaagactttcaaggcagcaacagcagagcattaaagcaactgcagtgtgcgcctgcgtgcagggccctgtgtgactgtgcaggttgcacagccatgaagctggccctaggatcacttaccagccagaacaaacagacaaaaataaaatattctttatccatctcccactttttctccatgctgcacctcaggttctagccaaattaactttagattctttgaaagtgtctgaagttgggttccctgaaaggtgtatttacttggaggtgatttttttgaggaagcgctccagggaggccagtaagagcctggaggaagcaggacaagcagagggggaagctgagcaaatgtgtcatctttcttttctctctctctcttttttttgtacaattttaaaattcattttattttgctatgtttccatctttctgtgtttccctggctggtctcaaactcctgagctcaagtgatcctcctgtctcagcctcctgagtagcccagccaagtgtgctatcttgataccaggagaaggcccataaagggaaggcttcagcttgagtccccgagggaacttgagtgtaatttcatctcagagttatcccaagctaaggtaagggagatgggtattcacatccagtgcactgactagtattggttaatagctgcctagtgcctctgggcaaacctgctgggctcccgaagactagcagcaggttctggccattgaaaggcagggagtggtaactcccatttgtctttcaggtcaccccttagcccttgcatctctgagaagcctttcttccctgattcctagatgtccccagatgatgcaagcttcttgaaaaaatgtccttgtcttgttcatttttgcacttctaaaacctaggaggcacctaatgagtatttgtgtaatggatgaagaaatgaaggtacctcatctaatgagagagcatcagcccaacaacttttattctcttctaaaccattttgggcttgttagggagacatagtcttaaacttctctttcagggtggttcagtgccccagactattactattagattttttccaatatattaaaaagctaataaaaattaataccttcaaaacccaaagtatagccacataaataattccacatacatgagccgtgaattcaccagtgacttaaaatataaccatacctccagtgaatccgcattttataagccattaaatctctcttttttatgtgaacagaaggtgcatccaggacttttaattgttaagaattttccttttgtttcccagtgagggcaaaagctatattctttttgaaatgggtacaaccctgtaatggcatgctttcctatttggatatgacagatatcctctcaggaactaaactcatttctgcatgacatacttgagacttggagaagtaaactacaatttatctcctctaaattgcactccccagttcagagcaggaggcagataacctcaatgtgaactttgcctatggatgtttatctacaggctccaaataatatggatttattctggtaatatacagaccatttggtagataacgttgagagcaaatattttattgctgatttcttgtaaattatacatggctgtgttttagtggattctccttccaaaccacagactcacaacatgagtagttatacagatttttattatgatcttgaatattgacttttaattatgcactggttaacaaaacaaataagactgtcacttccatcaagggagcattaaggatggagggtatccttttgacatctcttctatctttccatcccagtgctacttgctttaatatcacccatgccaggcataaaaagggaaaaatttcacattactttaagaagaccctagagcagtttgtagttatgtttattgcaaaagatacagggcttacagtaatggtagctgaaggacaccttaacaaccttattcaagagtaaggagggaaattcaaagagacgtgaggcattatttccatctcagtagaagacagactggacacaaaatacatttatattgaagccaaagaaggtagacaattgaatgaacttcctgactacaagaatattaggggaaagaagtcatcaaaaaatccaagagctaaattccactctttttgatatcttttggttcttaacatggccttatagaagactcagtaactcagtatctgacagcaatggcccaaaagttttgcagatctgaggtcagcatccagaaacggtgacccctctgacacccctcgcattctaagactcagtgatctcatccttggagataataagaggtgatgagaaacttctatgtgacgtgtatatttttagattctatttctaagtatgaggagggttaaaggcttttgaatttcttttctggcaattcaggcaagaaaataggtcaagagctcagtaggaccaagaagatcagtgatttatttctgtacggcggttggtgttctttttaaccctttctcacaagaatatcctgaaatatatcctgtgagaaaatgttaatggtgaagataaatgcagaatattgaggtcttggtgaatgttaattgtgtaataaatcttagtagaaagtatgaatgtgatccagtgactctttgacaatagtatagtttggatgcaatcaggttaatgtattttgtttagacttatagaaaatttgagctggaaaggacctcagaaatcaaatctaattatattattattcatttagtttttactggtggagcaactgagtcatttgccatctggataatagcatgggtgctgcaaattcaatccagtgtgatggtgtttccattccgttactctcttctaggatgccagttctctctgcaccttaccttatggaaaaagctagaattttgtagttgtttattttttatccctatagcaaaaaatgtaagaagatagtttttttttctcaatctgtgaaaaatgtgaaaaatggcaactactttaatgtcttgtaccaggttaaaatttttccatcaattcggtgccaccatggcaactttctaaacaaaagagcaataaaagggtggtgctcattattcttaaaaatcatcattacagaaaacaattacttggtcagtactatgaaacaatatttttacaaaccctagccaagcaacaggaaagctgtcaccatataacatcatctatatgaagatccactgggctccttcttatttcatcaattgacttccctgttttgttgtttgaaatggaattaaatcctgagtatattgaggaaaattggggagttcatggaaaatggtcactttgagtggagaatgtatgtattttggaagccaacattaaagtgagggtatttttcctaacacagaagagctttaaggttgcctccatacttttgcagaaataagtgccttcccagtagaatttcagccaccctagccaattatcaggaattatttctaccttgacaatgaaataaaccctcaataaggaaaaaaacataagcacactgcaatttgaggaacccgtgtgtatttcagagtctccaggaacaatgtgttgttaaacaaaatataaaatgtgcaataaactttaggtataaaggactttgttggctataaaattttattttactgctatcctcctatggctaaacatgttggagatcagtaaagtattaaaatatttaagatgacagaacatgaagcctaattctagaaatatagcagtgagaaagaatgacaaggggcagacacagaatgcctattccatcagctgcatactttccatcatttcagtgtatacttaatcttaaaagatacagagggtggagtgagcatgcgtggttgaccatcttaattacactctacacagagacaccagttgaaactgagagtgacaactttgtgtcagaatcacagtgttggagcaagtcccacgtggtcacttctttcttgcttaaacacacagtcaggatgttggagaattttcctgaggctcaacttactgttttcatgagtctatgggagcttataaaaatacatactgtttaaattttcctaaatgtgcatggaggcaaagatttttattctgaaatggaaaacctcttgttttccattgttaaggaaagactttgttacagaaataagtctccctgtggaaaattatagttttcaggtgagctatccctactaatcagactcaaggttgattggaacattacaaaattgtatgatttttcctttggaataaaaattactgaatgagagaagcaaaatcctaaaaatgagaagatgatggtgttttctactgaaccatttccaaagtagaattagaaaattatttgaatattctgctagacttacatgcatgattaattaggatggcaccgccaaaaccagattccttgcttttagagtgtctgtattaaatttgaacttgattttttcaatctctaattttcagttatctacacatggtttattgtggttttgttgctttttttgttgctctgtgtgtagagacatgtgtgtggatatgtgtgtgtgaatatgtgtgtgtggagagtgggtgtctcattattgtattcttagtttgtagcaaacttcctagcacatagtgggatattaactaatatatcttaaagaaagacacttgagtacgtttgcttttgtcctgtatttataaaagtaatactcattttagaaaaatataaaggagaataaaaaaatagacaaggaaactaagtttactcgtaatcttaccaaccagtaataatgttattaatcttttggtgtgactccaatcatctaatttatatatatatgtatatatgcatacagacagatatttctagaaacacacacacacacaccagacactcacaattggtttctgtattagttcattttcacattgctataacgaaccaactgagactgagtaatttatgaagaaaggaggtctaattgattcacagttccacatggctgaggaggcctcaggaaccttacaatcatggtggaaggcagagaggaagcaaggcatgtcttccatggcagcagaagagacagcgagtgaggggggaactgccaaacacttttcaaccattagatctcatgggaactcacccactatcatgagaacagcatgggggaaattgcctccatgatgcaatcacctcccattaagtcccttcctccacatgtggggattacaattcaagatgagatttgggtggggacccagaacaaaactatattagtaacaaaccaaatattcagctatgtagtcttttttcagtttaaccttaatgagttgaaaaatattctatcaaatgaaaaattctttataaagtttaccatgcccacttatgaaaaaactttaaaaccatgagctccacaagctagggttgaagaaagctcccctgtgtttcctttactggccagtagtgatgtttattgaacactcactaagtgatagaaactcttctaagcacttactcataatgtccaggtttaatctctacaacttttgaagtagatgccattaggatcgtccttttatgaactagagagtgtgacaaatttgctcaaattcatatagcaggttagagagctgaattttggacacagttttgctgaatctagaccctgaggtccaggtttgctgaacctagacttatgaacctctgggcatattactgccttccatggctatggtatacatctggacacgtctttagtcctttcaccctttgatcacttggtcctatttatcctgttggtaaaatgtctcctgttctccaacctcccatcaataccttaactcactggatctcaaccagggccagtttgccctcctggggacatttggggatgcctggagacatttttgtttgtcacaacttgaaggcagatgctactggtatctactgggtagggaccaaggatattgctaaacaccctacaatgtacaggacagcccctgcagcaaagaattatgcagcccaaaatgtcagtagcatcaaagttgagaatgctgccttagctcatttcctcaacctcttttgtctgaacataaatagccttctaatcagtttctttacctttagttttatccttatccacactgctgctatgactagctctttaaacacaaataaatcatgctgttctcttgctctgtttagctctgtcactctggatggctacctgggttcaaattatgattcaaacagttcaggatcatatgaccttgggcaagtgattcgtagcacctggctcaataatgttcttgtgaggattttaacactttgtagctagcataaattaagtcttcaataaatgctatctaccattttaaaaaaatctttgaaggctttctactgcctacagaagaaagcctatccttgtcaacatgatatcccttcactgtgttttattactcagagcctcttctctgggatactgccctggttgccctgtgtccagtcctgcaggactggaccctttagattaatggagacttgggtatcaggtgtctttgctcagactctgctgccagcttgggaagtccatctccagctcctccgcttggacacatctgtcttagccaagactcaggtcaaatgtaaccgtttctgtttaaccttatctaatagctagtcagatttatttactccttcccctacattttcacaacattttggttatatcatctctctttccatccatctatccatccatcctttgatcctttcatccatccacccacctattcattggctgtcatacatagtaattaagagggcaagctctggaaccagattttcttagttcaaaagtcagattccaaaaccaaactgagtaaccttgatcaagttacttgatcatgaagccttaatttccttgcatctcaaataagtataataatattatgtaattaataaattgacagtgagggttgaatgtatgtaaatcatttattatattgtctgttatgtacaaaccctaactaaatgttagctctcacccatttgtatttgttaaattcctactctgtgatgggtcctctttacatgatgccttgcattataataagttgtgcatgtgcccaactctccgattaggtgatgagcttgcagagtaaaggccccctccctgccccttaaaagtaatctcctctccactccagcacttgaaatataggtgaaaaaatcatttccatcaacatctagcctgtgtttcataatgtccttgctgggcagtatttctctcttaagatgctatgcatctactaacgtgagaagtatggccagtcaaaaggagcctgctattctcctggattggttgcatcctactcccacccctctcctcagcatttccaacccacatttcagctgcctctctgggagtcatacaatcacagtgaatctcttcctgattataataatggccttcagcctcctccattatgctggagctgaagagatgatgtcagtgacatattcctgtaggaagaactcagtgactgcttaattttccatgtaggtttttaatgctttgtattttgttaaaatccagatcacaatcttccactaagcaagtggtccaatctgattaatatagtacattctcctttgttgccaaacattgccaagggcaaggtaatacttagggaaccaccccctcctccaaacatacacacatataaatgaaaaataagtagatctgtacaatcattattgagctaaaatagcacttagaaatgtatttttattgtgaaaaatggccaaataagagttgctgactatttgtagccctgtaatgtaagtcagataaattggtgcccagaagtctgacatttcaaaagcccaggaatatgtcgcattttttctggtatgccatttttgtaattctcccagctattttcctttagcaagaagcaattcttctgtgcccaagcagctcaattagagcattgtaaaagttgtcataatgactttaacataagtgcccctgagcaatagggataattttggaggggagcaagttccgctgttactttcctggtatggaaaatggtaatagcttgcttggagaagaaatgcaccatctgtaacttaactcagttaacctgctcggagaactaaaaacacactatctcacctgaagtggttttcctgttttggtcttttcaacatctttgtaccttctgtagccaacagcactctccttttcctctcagtgcacatatattaggtgactccacctctgtggtggtttataacagtactccccagccttttgggcaccaggcaccggttccatggaaagcactttttccacagatgggctgggggtgggggatggttttggaatgaaactgttccatctcagatcatcaaatattagattattataagaaatgtgcaacctagatcccttgcatgtgcagttcacaatagggttcatgctcgtatgagaatctaatgccctgctgatctgacaggaggtagagctcaggcggtaatgctcacttgcctcctgctgtgtggcccagctcctaacaggccacggattggtactggtccatggcctgggggttagggacccctggtttagaatatacctacaaattctccccttgaatatcaactggcctccgtgatttacttctaataaatagaatgcagcagaaattacactgtctgacatttgagcacaggtcagcggtcagcgcattttttctgcaaatgctcacattgtaaatattttcagcttcacaggccatacccacatggcctctgtcacaactccatagctctgctattgtagcatgtagcagccatagataatatacagacaaccttggctattttctgatgaaaatttatttcaccttgaagccaccatgctagagaggttatgaggaaagaatacatagagatagaaagagatgctcatgaagccccagcgtccaagccatcttcccttgcaggtatgtgaggaggaggccttcaagatgagtccagcttagccaccatctggatgcaactacactgtgagacccccagtgagaacagattagctggtgcagtcaactcccagaactgtgacagatgatgataatgacaataatgatataatggctttgggatgggcacatgatctagacctcacttatccgtatattttaactccctgccaatattactttgtagaggaagggacacgtgcctcagtttgatccaatgagatgcagttccttgatcttgaggaagagtggaggaactctccttttgctatgtttctaaccagacaacctgaggctgctcgtggacattttgataccacatgggaagagcctgtccaagataataaccaacaaagaagaaaccagggcagataagcagagagctagagagacagattctgaaggcatcgtttgggtatcattacagagttgttcctgaacactaaccatgtgtatttcagttataggagccaattgtttaaacttttcattatagtaagatatatattcataaatcataagtgtataggttgatgattttaacaaactgaccacagccatgtagccaggacccaggttaagagaccaaagtttgccactcttccaactgcctatctcttgcctcttttcagcttttctccaaagataaccactagctttgacagcatatattagttgttttactttttgtgctttgttccaatgtaatcatacagtatgcactcttttgcatctgacttgttattttctcccttttatttttggttgacacataatagttgtacatatttatgggatacagagtaatattttaatacatgtatacaatgtgtaatgatcaaatcagagtaattagaatatccatcaccttaaatgtttatcatttctttgtattgtgaacattcaaaatcctctcttctagctttgtgaaaatatatgataaattattgttaactgtatttgccctatagtgccatagaacatgagaacttattcctcttattatctagctatctagctgtaattttgtatcttgaaccaacctctccctatccttccctgcctcctactcatcccagcctctataaccacaattttcctctgttcagttgttcaactcccacatgtgtgtgagaacacatagtatttatttttctttgatgacttatttcacttaacataataccttccagactttttcatgttgccacaaatgacaggattttattctttttaatggttggatagcttctattgtgtatatataccatattttctttatctattcatctggtgatgaacatttaggttgatcccatatcttggctatgtgaatagtgttgcaataaacatggggggcagatatatgcttgtaaaagaattgccttttctctgcatcctcttctgcatttgttattttttgtctttttgataataaccattctgatgggagtgaggtgatatctcactgtagtttggatttacattttcctaatgattggtgatattgagcatttttttcatatacttcttggccatttgtatatcttcttttgagaagtgttttttcagatcctttgcccacttttaagtcagatctttttttgtatgaattgtttgagttccttgtatattctggatattagttccttttcagattaatagtttgcaaatattttttctcgttcaacacattgtctctctctcatgttgattgtttcctttggtgtacagaagctttttagtttgatatagtgccatttgtctttttttgtttctgttgcttgtgcttttgaaatcttagtcataagttttttgcctagaccaatgtcctcaagtgtttcccctatgttttcttctagtgattttatagtttcaggtcttatatttaagtcttcaattcattttgagtttatttttgtatatggtgacagacagggatcatttcattcttctacatatggatatccagtttttctaccatctctttttgaagaggttgtgctttcctcaatatgtattcttggtgcctttgtcaaaaattagttggctgtaaacatatggatttaatgctaggttctctgttactttccactggtctgtgtgtctgtttttataccaatactatgctgttttgtttgctgtagctttgtagtacattttgaagtcaggtggtgtggtactttcagctttgttctttttgctcagcatagctttggctactcaaggtcttttatggtttcatacaaattttggaacagtttttaaaagttcctgtaaagaaggtcattgatattttgataggaattgcattgaatctgtagattgttttgggtgtataatcattttaacaatgttaatttttttgttctatgagcctgatatgtctttccatttgttgttgttgttgtgttgcctcttcaatttcttttatcagcatttcgtggttttcattatagagatctttcaccttcttggttaaatttatatctaggtattttacatattttttgtagctatggaattgcagtttgatttctttttcaactagttctttattgatgtatagaaacactactgatttttgtatatattgatgcagtattctgccactttactagatttgtctgtgctaagggtatttatttatctttaggtttttctatatacaagataatgtactctgtgaagagggacaatttgactttctattttctaatttgaatgccctttaattcttctcttgctaattactctagctaggacttccaatactgtgttgagtagaagtggtgaaagtgggcatttttgtctttctccaccttttagagcgaaggctttcagctttgccccgttcagtataatgttagttatgggtttgtcctatatatggctgtttttgttttgaggtatgttccttctatatttaatttgtttaaagtttttaaaatcattttataaaatattttttctgtgtttattgagatgatcacatgatttttgggttttattctgttgatgtgatgtattacattcattgatttgcaaatgttgaaccaaccttgcatccctggggtaaatcccagtttagcatgatgtattatttttttcaatgcactgtttgattcagtttgctggtattttgttgagaatttttacagctttcttcatcagggatattgtcctgcagttttctttttttgttatgtctttttctggttttggtatgagggtaatgctggtctcatagaatgtgttaggaagaatttcctccgcttcaatttttgaaatggtttgagaagatttaatgtgacttctttagaagtttggaatttagcagtaaagctattcagactaggctattctttgttgggagactttttattaacaatgaatctcattaattattattggtctcttcagtttttctatgacttcctgattcagtcttggtaggttatatatgtccaggaatttatacatttcttgcaggttttccaatttgttggtgtataattgttcataacagtttctaatagtcctttgtatttctgtggtatcagttgtaaagtctccatttttttgcttctgattttatttattagggtcttctccttttcttaatttagctaatggtatgttgattttgtttatcttttcaaaaaaacctgctttttgctttgttggccttttgtattttttttatctcaacgtcttttagttgtgctataatctttattatttttttccttctatcagttttgggtttggtttgttcttgcttgtctagttccttgaagtgcgtaattaggttgtttatttgaaatccttgtacatttttgatgtagtcatttattgctaaaaatttccctcttagtactgcttttgttatatcccatgagttttggtatgtttctattttcatttgtttcaagacttttttttatttctttctcaatgtcttcattaactgaataatcattcagaaacatgtttaatttgcatttacagttctgtaagagtctcttaggtccattttgtctatagtgcagtttaagtccaatgttccttgctgagtttctgtctaggtgatttgtgcaatactgaaagtgaggtgttgaagttcccagctcttactatattattagagctaacttgttatatacctgggtgcttctttgttgggtacatatataattgttatatcttctttttttattattatactttaagttttagggtacatgtgcacaatgtgcaggtttgttacatatgtatacatgtgccatgttggtgtgctgcacccattaacttgtcattaacattaggtatatctcctaatgctatccctccaccctccccccaccccacaacatatatcttcttgctgaatttgtccctttatcattatataatcaccttcttgatttcttttttttttcacttaaagtctgttttttctgatataagtacagctgtttctacatgcttttgatttccatttgtgtggaatacctttttatatcccttaactctaagtctatgtgtgtatttatggacgaagtaccttctcacaggcaacatatggttgagttttttaaaacatctattcagccagtctgtatcttttaaccgggaattcaaactttacaatcaaggtttttattgatggaagagaacttactcttgtcattttgttcatcgttatctaattattttatatatcctatgttccttcatttatgtcttgtgatttatctttgtgatatggtggttttctgtagtaatgacattctccaggtgtcaagatgatgttttactttgggacctcaattttctgatggatccaagaaaagccattgattttcaatttgatcagctttttattgttgttttaaggatggaaatgattggaatgtgactaccactttacatatcagaactgaaatgggaagcttatacattaaagttttagaggactcactttttattctttttggaatcttttttgtgtttttttgatactaatttacaaaattcgtgttttttagtacggattagtgacactggaatgatagtcaagtcacttttaacttcattgttctaaatttcttttaaaaaattgttttgaaacaggttcctgctctgtcacccagcctggagtgcagtaatacaatcatagctcactacagcctcgaactcctgggctcaactgattctcttgcctcagcctcctgaatagctgggacaacaggcatgtgccaccacacccggctaatattttttacgttttgtggaagtggagtctcactatgttacccaggctggcctcaaactcatgagttcaaaacatactcctgtcttagcctctcaaaatcctgggattatagatgtgagccaggataactggcccattattctaaattccaatcattcatgagtctatgaaaaatttataacaaatgactactttggagttcaataagctgagtaactcagcctcagtcacacaactaactaaccccagagaagagacccaaatctctctggtcctctggacacattgctcagtgatcttgcctctgcatctttctaaggtctggtttcactctataattttctttcaaaccatggtatgactgtgaacctagtgtactttctgttatcttgttggggaaaaattataatacataattcaatagcatacacattatttgctttcctttgtagattccagggagtctaccaacttataacacattaaaaaatcatttaaaggtattagaaaggtattttttggttgagtaaaagtggaaatgtatgaacagtttaaaattttttttttggttgttgagtgatcttcactttgaatactgaaggagtctgatttcattctattggtttttcaatgacaggtatgtccttaaaattcaactatttatttaggctgtcactaaagaaaactgctgacatggtaaaagcccatggtataagtaccaagcctaaaaatatgtggagtgtttagagagaatataaaaaaaaaaaagatatgtaaaagaatgtgaattaagccagcagtttgtctttgaaaaagagagtgttgatttggggcttctgatctgtatgctaccccatttctctactgatatttctctactgatagtaaagatgttcaaaggcacctaaaagtctgaactattaagaagctatactccaaaatcaatgttagttttgtctctcactccttcacagacaggctttttttttttttttttttttttttaaatcaattcctgtttggggctaattgtttaaaagccatgacttcattttcaggttaaatacatgtctcttccattctgagaattaaaaaaaaagaaaagaaaaaaaaaaaacagtctttgagtactatgttcaatttactaaaaatatctagaaaactaaagtattcccaaaggcaaatctttggtgtgacagatgtaaaataatatccacaagctgaagggtctgtcttagaaaagcattctgcaactgcttcaacaagagtactgggtgtcatttataattcatgcaagtatattgaagctttctgctgtcgtccaagaaagatggttttcaaagctacagagtgcaataatccaatattccttgtagagagtcccatatatctcatatagattttacactggagatcatttccatgctgatgacctcaagaatacaatgtgatattttcagaaaacacagatttatgctatgtgctatttctgtgggcttgggggacaaccattagatcattaagttgaaggtatatttctagtcagacttaatccacattgcagtggtcactacaaaaaaaaatgtgtatctaaatgcctcaagaacttcagtttttgtgttcaacatattttgcagtggaaaatgagtttgatgatcagagtgtactcctatagaaggcaaaatgaccatgagaataattagaataattcaatcatttcttcttcttcttcttcttcttttttttttttaaacagagtcttgctctgtcgcccatgctggagtgcactggagtgatctcggctcactgcaagctccgcctcccgggttcacgccattctcctgcctcagtctcccgagtagctgggactacaggcactcgccaccacgcccggctaatttttttgtatttttagtagagtcagggtttcatcgtgttagccaggatggtcttgatctcctgacctcgtgatccgcccacctcggcctcccaaagtgctaggaatacaggcgtgagccactgtgcctggcctcaatcatttcttctaaagtacaggactttgaatatgagatcagcttatattcaaaatcaatttaataattaaatcaaatttaaatattaaattatttgcaggccaaaagaagtgagcttcctaaagtgacacccaatactcttgttaaagctgctacagaatgcttttctaagaaagacccttcagcttatgggtgttattttacatctgtcacacaaaagatttctctttggaaacaatttagtattctaaatatttttagttaattgaacatagtactcaaagactgacttttgttgccactatgagaacatggtaatgtcacaggtcaaccaataacaggtagttattacaggctctgattaacactacagtgcatttgaagaccacatagtcagaaaataatcaaagacattttcaatagaccaatgtgtgcaatataatctatcataaaaatccagttatgagaaattctccatccacagtaaccttttgagtagcacctgcccttcaatatttccctcctttcttttcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaaggtatcaatgaacgaacaaataaattaatgagctgatgtattgattaaatgaatttacttctttcagatttacttttccaaactaaaaaaaaattgttttaaactttgttccaaagttatacagtttttacaaaaataaaactttatttttgaattgctttatatttacagaaaagttgcaaagatatggaaagttgcctcaccctataattagcttctgacattagtatggtacatttgtcacaattattgaaccagtattgatgatatgttattattaactaaattctatactttataaagatttcctcagtttttacctaatgccatttctctgttccaggaacccatcccagaaatcacatttcatattgatatcaagtttcctaagactcctcttcgtaggtacagtttcagggccaaaattttaagggccttgagtgttttgagcagtactggacaggtgttttttaggatgtccctcgactgagctttgactgatgaattgctcatgattgaattgggactatgggtcttcagaagaaagatcatgagccctttttgtcacatcatgtcaaagataccatgccatcaatacaacttattactgatgatgttgacattgaccacttgactgagataacatttgtcagatttctccactgtaaagttacttttccccactttccatactatactcttttgtaggaagtcactatgcacaggccatacttaaagagagctccatctccttgagggcagagtaactacattaaatatttgaaatctttctgcccaggagatttgtctatttttccaatttatttattcaatctattattattatgttagatatgagaccttgctatgttgcctagatgggtctcaaactcctgagctcaagtaatccttctgtctcagcctcctgagcaggtgggactataggcatgcaccactgcacctgacaatcatttattgatggcagtatgaactcatggacatttgttttatccttaagttataacccaatattatattattttattgctaaattatttcagttttggccattgaagctcttttgtttaatgcccatgtcattttgacatacctctatcattgtgggatttctttttacttttttgcagatatttctttagtttttggcactacaagaggctctagtttcatcatctatcctgccccagcccaagattcaaccatttcttcaagtagcccttgctcttttttactgtacattgtaattaataatcaagttcttggcactaggttcttcagaaatttttttttagtttatatgtttgttgataaggtattgataaagattctgctagtgattaccaatgtaacttttggcaaattatctgaaacatggaaataataatttctacttcataggactgttgtacattttaaatggattcactaggatagtgcacggagtaaaaggaaacaaatagtaactctaaatggtattattacaaattcattggaaataaataaatgtaaatttgcttccaaaagtcaatctgaattctctggaagttttgtttctgctttgacatgttttcattgctatatacgtagactaagaagttagagactctgattctaggcctagctcggttgttaaaaagaattcactccagtcatctaatgcctcctcttttaaaatgggtataatactctttgctgactttaaccccacagggttagtctattggtgtaattgatataaaatgaagtttatacaaatgtataggtggcaatattaccaccatttttgtcggtatcataggcctctgattcattcattgctctttgcagctccattttctttctccttttcttaaaaagtgttgaccatactatcttgaatccatctatttattataaactttaattatgtcaggttttgaaaaactagtattcaagtttagacaacacaattgtgttcaaatgctattacaacgaatccacattgcacaactattttagagacttaaaatttagttaacatttttctaattagttcgcagacagtagtaagctggtgagcccacctagttcttggtcttgagaaattttcattcaactaagcataactaagcctactgagttactaagtcataaagaaagtagaaatatagatgtttgggaaagtaagggatagcaggagtgtgtggcatcttaaaaatgccctagtatcaaattattgatgcaaagcagttggctactgtcttaaaaggaagggacatcaaccatctagacaagatcaaatatcaaagtcgatgggttttgcaaactgatcatcttgttttcctcttaccaaggtaaagcaaggtgcttcgacacacctgatagattacagactgtatcaatatcactatatgagtaatgttgatctccataggatgtgtcaaccttcaaaaacattttaacaggtttatgtaattgtttgctatctcgttgttgggcagtatggataagaaaaagtgaatatttagctctaaatcctttgagcctcacttccttcaaaatacctgtcagatcatctgcaaaaattcactctaattgatcttaagacttaatggcaacatgttgagaaggagaattgaactgggttcccatgctaaatgtgtttaaagtcacttctctgatttattttctttctttcatggacagcaaattcaaacttaactatttgtacgtatcagtgaataccttttgttatgggtgtaagatttatttgcaaatcggcaaaatggttaatcaaatattttgtgtgcattatctgatctcttaacctttctgtgcatctgattcataaataaccaaatatattaataattctttttttttttttttgagacagagtctcactctattgcccaggctggagtgcagtggcatgatctcggtacactgcaagctctgtctcctgagttcaagcgattctcatgcctcagcctcccgagtagctgggattacaggtgtgcaccaccatacatggctaatttttttgtacttttagtaaagacggggtttcaccatgttggacaggctggtcttgaactcctgaactcaggtgatccacttgccttggcctcacagagtgccatggccagccaataattcttagtaatccttagatggatgtggtcttaactattaacgcatgtttattttagatttgccatttcaacagatttattggtttcttttttctctcagcctcctagctacctttaaaaaattgaaaatggaatcccatacctgcataaatattaagggcaaattaacttcaaggctgtgtagagacaggaagactcagatccatatttacatgttttacctgggaatgggggtgggattcagaagaatagaaaagataattgtttccccactgattatacttcctgtgtttcattttcagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatgcaacctactttaaaaggtaaacagataaaagaaaataccgaagactgaaaatgcagaaaattcaaccatgcagcccattccaaattaaatatgtcttcctctctaattcctctcttctagcagagaaggggagatgagctatgactccatgctcatgcttaacaaaattgtgttagattggtgcaaaagtaattgcagtttttgccatttaaaagtaattgcaatgttatctcctagaatttttatagtttcaggtcttaagtttaagtccttaatccatcttgagctgattttttgtatagggctggacgttcgcttaggcaaggatttcatgaccaacaacctgaaaggaaatgcaataaaaacaaagataaatagctggaacctagttaaactaaagagcttttgcatggcaaaaagaagagtcagcagagcaaacagataacaaacagagtgggagaaaaccttcataatctgtacatctgacaaagtgctaatatccagaatctacaatgaactcaaacaaatcagtaagaaaaaaacaattccatcagaaagtggctaaggatatgaataggcaattctcaaaagaagatatacaaatggccaacaaacataggaaaaaacgctcaacatcacaaatgatcagggaaatgcaaatcaaaaccacaatgcgataccacctcactcctgcaagaatggccataattaaaaaaaaaaatcaaaaaacagtagatgttagcatggatgcggtgaacagggaacacttctacactgctggtgggaatgtaaactagtaaagccactatggaaaacagtgtggagattccttgaagaattaaaagtagaactaccatttgatccagcaatcccactactgggtatctacccagaggaaaagaagtcactattcaaaaaagatacttgcacacacatgtttatagtggcacaattcaaaatagcaaaatcgtggaaccaacccaaatgcccatcaatcaacaagtggataaagaaactgtggtatgtatatataatggaatactatgcagccataaaaaggaatgaattaacagcatttgcagtgacctgaatgagattggaaacttattctaagtaaagtaactcaggaatggaaaaccaaacatcatatcttctcacagatatatgggaactaagttatgaggactcaaaggcataagaatgatacaatggactttggggacttggggggaagggtgagaagtgggtgaggtataaaacactacaaatatgctgcggtgtatactgcgcaggtgatgggtgcacgaaaatctcacaaatcatccctaaagaacttactcatgtaaccaaataccatctatacctcaataacttatggggaaaaaagtaattgcaaaaactgcaattacctttgcatgaaccaaaggcctactttggagagtcagaggaattcttaaccataattcaaccaagacatacggtatgtgccttctctttggtggaacagtgaatatacaggctactagcctgtactgagtgtttcagccaaaacacattcttttaaaagtcacagttttaagtgacaatatcccaatgaaaatacaaattaaaaaatgcattggcatatctatattccctcccaaaataacacacatttggaatatataaagaactcttaaaagtcaatgagaaaaaaagcaatagctcagtagaaaagtgggaagaagacttggacacttcagaaaagagaatatattaaaatagtccataaacagaaataaaaggtgctcaactttatgagtcatctgggatatgtagattaaaaccacagtgcaatattataccacccctaccagaataactaaaaagagtaagttggaaaatactcagtgctgatgagaaagtggggtaattgaaactcttatacatcattctaggaacatccacttaggaaaacaacttggcagtgtctaataaagtccagtatatgcattccctataacccagaatttttactctcaggtgtatacccaacagaaatgcaggtgtgtgttcaccagaaatcatgttcaagaatgttcatggtatcactagtcatgaggcacaaaaactggaaatgttcatcaacaatgagtaggataaataagttgtgttaatatttatacaattgaaaattatacagcagaaagaataaataatctaaacctacacacaacagcatgaagaaatctcatgagtggaatgttagatcataacctaaataaacttacctggagcaggtgccactgaagccataaaatggtaggatgaattgctggaggctgactatggactagcttgacagtaaaaaatttggggaggtccattctgaaggaggcccctcacactttcttggattttatcttcaggaagcccaccagattttcatggtgaagatcttagaaaacatctctcatatcttggtcagttgggggaaagtagcattttgaaataatcctagagcattctccatagccaaggtttactcctcaacggaaacaactttaccagagccttagttgaccatggagaagggcagttagccccctacatccctctctagctttcttgtgttacttagtggaaggaaaaaaaggataagaaacacttctgaagtccaattcagggacttgagcccactaaaagactgaaatatacttacctcctccacaccttaccaccacatcaacacagctccagaataatcacaatgggttacaatggaaagagctgcaaaacatagactctatttaagaaggaattcttagggaaatccaatgtggagaaaacaaagacactgaggaaactaaagtctctggcatctatagctatggaaaacatgaagcacaacccatctgctaggcagattgacataaaacctcatactaaagacctattttcctcagttctcattacctgatacatcatgtttgacttttaacaaaaaatcataaggaaggctatacaaaaagaaaaggaaaaacacagtcagaagagacaaagtaagcatctgaactagactttgacatgaaacaaagtttggaataatcaaatagataattaaaaataactatgattagttatgttaaggactgtaatagaaaaagtataagcatgcaagagcagatgaataatataagcagaataatgaaaactctaagaaagaatcagaagaaaatgacagaaatgaaaaacactgcaacagaaatgaagaatgcctttgataagctcattactaaactgaacataaacaaggaaataatcaataatttaaagatatatcaaaggagacattgcaaattgaaatactaagagaaaaaggactacaacctccattccaatatccaagaacaattacaaaaatataacatatgcataattgaagtactagaagaagaagaaaggagcagaggaagtgcagaggaagtacagtagttccctcttatccatggtggatacattcaaagacccccagtggatgcctgaaaatgcagatagtaccaaaccctacctatacattctatgttttttcctatatgtacatatctatgataaggtttaacttataaattaggcataaaaagagtttaacagtataataaaatagaaaaattataacaatactcagaaccaagcacaactgaaaacttgtgaaatgtttatttctgggcatggtggctcatgcctgtaatcccaacactttgcaaagccaaggcagatggattgcttgagctcaggagtttaagaccagtgtgggaagcatggtgaaacctcatctctacaaaaaatacaaaaaattatctaggtgtagtggcacatgcccatagttccagctactcggggtggtgggagggtgtgtggtggggggcagtgtggggtggaagggagctgaaatgggataatcgcttgagaccaggaagtcaaggctgtactgagccttgactgggccactgcactccagcctgggtgacagaatgagaccctgtctcaaaaaaaaaaaaaaaggaaaattattaaggataaagatgggcattaaataatgagaaaggggcaattatccaaaaaacataataattcttaagttatgcaggtaacacagcatctaaatacatgagacaaaaatttataaaactgcaagaagaaataatcaaatttaatattatttaataatatttttggagatctcaacatccctatattaataacagctaatttcaacaagcagaaatcaggaaaatgttcaactgaatagcactaacaatgaacaggatctaactgttcaagtagcagcagaataattaatcaagtaacagcagaatacatattcctctcaagtttatatgggactttatgcaaaatagaccacattctggggctgaaaaagatgccctcacaaatttaaaagaatagaaggtttactgcatgtgttcttagactataatgaaatttaactggaaatcagtgccagaaaaaaactcagaagtccccaaatagtttgagattaaataacatacttttatataacacataggtcaaagaagaagtctcaaaggaaatttaaaaatatttcgaactaaacaaaatgaaatgtacatcaaaatttatgggatgctcaggaaaaatagctagtggatgcttggcttcatacctaggtgatgggttgatctgtgcagcaaagcaccatggcacacgtttacctatgtaacaaacctgcacatcctgcacatgtaccctggaactgaaaataaaaattgattaaaaaagaaagagaaaggataattcctttcacccacagtttcctgtctcctaatagtccttctgttgtgtctttaaataaatgtgtctcaaatcttaagatattcataaaatctgggattgcagatgtattttgcattacaagtcctatttttattttttaatggaatgctgtaaaagcagttcttagaggcaaatttatagcagcaaatgcatatattagaaaagaagaaaaatctaaaatcactaatagaaatgtgccttaggaaagtaaagagaggagagcaatttaagcctcaagtaagcagaagaaaagacataaaactttgagcagaaatcaataaaattgaaaacatgaggtcaacagagaaagtcaataaacccaaaaggcaatgcctttaaaagatcaataaaatcgataaatccatagccaggctaaccaagtgaaaaagggagaagacacaaattataaatattgattccatagacattaaaaagataataaaagaacattacaaacaaatgtatactgacacttttggtaatttagatgaaatgaatcaattccttgaaagacataaaccatcaaaacttatggaaaagaaatacattacctaaatagatctatatttatttaaaaaatagataaatcattaataatctttcgaaaaagaaagcgtctcgcccagattctttcactaatgaattccaccaagcatttaaggaagaaataatgtcagttctctataatcacttttagaaaatagaagtaagaggtatacctcctaactcattcaaggaggcaggcattatcttaatatcaaaaccggggaaatacactacaagaaatgaaacctacagctcaatatattttatgaatatagatggaaaaattttcaataaaatattagctaattgaatccaaaaatatataaaaatagtaatacatcacagtaagtgcaatttattttaggcataccagactgatctgacatttattaactggctaaagaactattttatgattctgtcaattgatgcagagaaagcatttgacaaactccaacatctatttatgagaaaaagtcttagaaaactaggaataaaaaacatcctcaacttaatctggaacatctaaaaaatgggacttcacgctattttatggtgagaaatgatatgcttttcttctatattgggaacaagacaaggttctttttttgccactcttattcaccatcctactggatgtcctaattagtgcaacaaggcaagaaaaaatatatatacagattagaaagaaaaaaagaaaactacctctgttcaagatgacataattacttatttagtaaaactgaaagaattgactcctggaattaatatgtgattatagcaaggttgcaggatgcgaggttaatagaagtcaattgtgtttccatgtaccaccagtgaacaagtgaaaattgaagttgaaaacaaaatacaatttcattccttcccccagcaaaaatgaaatataaacaacaaaatatgtatacaacgtatattatgtatatggaaaattttaagtctgatgaaagaaataaaggaagatctaaataaatggagatgtaccactttcatggataagtagattcaataatgttgagatataaattcttcacgaattggtgtatacatttaatacaattctaataaattctcagcaagttattttgtggttattgacaaatttattctattttttagcttcatctcaaaagatgattttaaaatttatatggaaatgcaagagacccagaatagtctacataatactgaccaaaggactaagttggagaactgacactactcatagtactacaaagctacagtaattatgacagtgaggtatttgtacaagaatagacaaatggattaatagaaaagaggagagagcctcttttagaccctcaactgatccttgacagagcaaaataaattcaattgagaaaggacagtcttttcaacaaataatcatcaaaaattgtgcatatacatgcaaaaatgaatctagacatataccttatgcttttcacaaaaattaatttaaaatggaccttagttctaaatgtaaaacaaaaactagaaaacttctatgagatagcataggagaaaatctaggtgaccttgggtttgattaaatcatgatccatgaaagaaaaaaattaaaaaaaaattgaacttaattaaatttaaaaattgttatgtgaaatatattgttaagtaaatgagaagacaagccacagaatgagagaaaatattttaaaaacatatccagtaaaggagttaaatccaaatgacaccaaggtatttaaataattctatgtaatgatcaaaagatctgaacattcaactcaccaaataagatgtacagatggcatataagcatatgaaaagatgctcaacatcttatgttattagagaatagtaaattaaaacaacaatgagaaaccactacacctattagaatggctgaaatccaaattactgacaacaaccaatgctgttgagaatgcaatgcaagagaaactctagttcatccaattttcaaatgtgactgtaaaaggctgcagccactttagaagacattttgtctgtttcttacaaagctaagcatagccttgcattataatctgcagttgtgttcctctgtatatacccaattacactgaaacattatgtctacaaaaaaatcctgaaaacaaatgtttatagcaggtttattgttacttggtagttaccaaaaatggaaaacaatcaagatgtctttcaatagatgagtgaataaactataagatatccataaaatggaatattattcagcagtaaaaagaaatgagctttcaaatcatgaaaagacatggaggaaactcaaatgcatactgttacatgaaagcagccagtgtgaaaaggctacatgctatataatttcaattagatgacattttggaaagaagcaaaactgtaaagaaaaagatcagtttttgcctggcgttcagggaaagggaagaataagttaagcacaggagacttggggagctgtgaaatgattctgtgcaatattggtggaattttggcaacattatgcatttgccaaaggcaatagaagtttttgacacaaagagttaccataatgcaggcaaattttagaaaattatttagaaggtcagaggatcccagaagcaatgtggactttacagaagaaattcactgcattacaaagcatcagataaccttagtaaggtggagagagaaaatggtcttaacataaatatctttaaaaatgaatggaatctgtcagactataggcaagatgagctgcacaaaagcactgtactctagctgataaaattatttctcattggcttctggttaacagttctgatactgctatacatatatatgggaattgaataattaagcctataaatggcaaacattgggagttatatttctcacggtgtggaaatttacagatcaactaggggaacagtcttgaataatcaatgtgatgatcattacagttggagacatcaaggagaactaatgtttaacttaatatagatatgggtggttatatatagaaatattcaaagatgtttatgtaaatacacaaaagcacaaccatgacacatctaaaataaataacaccctggtaaccatgggcacacttagtactcaaatgctggagtgcaatggcgtgatcttggctcactgcaacctctgccccctgggtttaagcaattctccagcctcagccaccagagtagcagtgattacaggcactcaccaccacacctggctaatttttgtatttttagtagagacagggtttcaccatgttggccaggcttatctcgaactcctgaccttgtgatctgccctccttggcctcccaaggtgctgggattacaggcatgagctaccaggcctggcctgttgattttttcttttttttttttttattatactttaagttctgggatacatgtgcagaatgtgcaggtttggaacatagatatacacgtgccatagtggtttgctgcacccatcaatcggtcatctatattagatatttctcctaatgttatccctcccctagttccctacccaccaaagggcccagtgtgtgatgttcccctccctgtgtccatgtgttctcttttttcaactcccacttatgagtgagaacatgcagtgtttggttttctgttcctgtgttagcttgctgagaatgatggtttccagcttcatccatgtccctgcaaaggacatgagctcatccttttttatggctgcatagtattccatggtgtatatgtgccacattttctttatccagtctatcactgatgagcatttgggttgattccaagtctttgttgttgtgaacagtgttgcagtaaatgggtgtgtgtctttgtagaatgatttataatcctttgggtatatacccagtgatgggattgctggatcaaatggtatttctggttctagatccttgaggaattgccacactgtcttccacaatgggtgatctaatttacactcccaccaacagtgtaaaagccttcctatttgtccacatcctctccagcatctgttgtttcctgactttttaatgatcgccattttaactggcgtgagatggtatctcactgtggttttgatttgcatttctctaatgaccagtgatgatgagctttttttcatatgtttgttggccacataaatgtcttcttttgagaagtgtctgtttatatcctttgcccactttttgatggggttgtttgtttttttttctcgtaaatttgtttaggttctttgtagattctggatattagcccttcggcagatgagtagattgcaaaaaggttctcccattctgtaggttgtctgttcactctgatgatagtttcttttgctgtttagaaactctttagtttaattagatcccatttgtcaattttgacatttgttgccattgcttttggtgttttagtcatgaagtctttgcccatgcctatgtcctgaatggtatagcctaggttttcttctggggttttcatagttagaggttttatgtttaagtctttaatccatcttgagttcgtttttgtacaaggtctgaggaagggttcagtatcagttttctgcatatagctagccagttttcccaacaccatttattaaatagggaatacatcccccattgcttgtatttgtcgggttcgtcaaagatcagatggttgtagatgtgtggcattatttctgaggcctctgttctgtttcattggtctatatatctgttttggtaccagtaccatgctgttttggttactgtagcattgtagtagagtttgaagtcaggtagcgtaatacctccagctttgttctttttgcttagaattgtcttgactatgcgggctcttttttggttccatatgaaatttaaagtagttttttctagttctgtgaagaaagtcaatggttgcttgatggggatagcactgaatctataacttactttgggcagtatggccattttgatgatattgattcttcctatccgtgggcatgatatgtttttccatttgtttgtgtcgtctcttatttccttgagcagtggtttgtagttctccttgaagaggtccttcacataccatgtaagttttattcctgggtactttattctctttgtagcaattgtgaatggaagttcactcatgatttggctctctgtttgcctattattggtgtatacaaatgcttgtgatttttgcacactgcttttgtatcctgagattttgctgaagttgcttatcaacttgagattttgggccgaaatggtggggtattctaaatacacaatcatatcatctgcaagcagagacaatttgacttcctgtcttcctatttgaaaactctttatttcgttctcctgcctgatgaccctggctagaacttccaatatatggtgaataggagtggtgagagagggcatccttttcttgtgccagttttcaaagggaatgcttccagttcttgcccatttagtatgatatcggctgtgagtttcttgtaaataactattattattttgagatatgttccatcaatacctagtttactgacagtttttagcatgaagctgtgttgaattttatcaaaggcgttttctgcgtctattgagataatcatgtgatttttgtcatcagttttgtttatgtgatggattatgtttattgatttgcatatgttgaaccagccttgcatcccagggattaagctgacttgattgtggaggataaactttttgatgtgctgctggattcggtttgccagtattttattgaggatttttgcatcgatgttcatcagggatattggcctgaaattttccttttttgttgtgtctcttccaggttttggtatcagaatgatgctggcctcataaaatgagttagggaggagtccctctttttctattgtttggaatcatttcaggaggaatggtaccagctcctctttttacctctggtagaatttggctgtgaatccatctggtcctgggctttttttggctggtaggctattaattactgcctcaatttcagaacttgttattggtctattcaagaatttgacttcttcctagtttagtcttgggagggtgtatgtgttgaggaatttatccatttctgctagattttctagtttattttcatagaggtgtttatagtattctctgatggtagtttgtatttctgtgggatcagtagtcatcttccctttatcatttcttattgtgtctatttgattcttctctcttttcttctttattagtctggctaacagtctatctattttgttaatcttttcaaaaaaccagctcatggatgcatttacgttttcgaagggtttttcatgtccctgtcttcttcaattctgctctgatcttagttatttcttatcttctgctagcttttgaatttgtttgctcttgcttctctagttcttttaattgtgatgttaaggtgtcaattttagatctttcccactttctactgtgggcatttaatgctataaatttccctctaaaaactgctttagctatgtcccagagattctggtacattgtatctttgttctcattggtttcaaagaactcatttatttctgccttaattttgttttttacccagtagtcattcagaagaaggttgttcagtttccatgcagttgtgctgttttgagggagtttcttaatcatgagttctaatttgattgcactgtggtttgagagatggtttgttgtgatttctgctcttttggatttttctgaggagtgttttatttctaattgtgtggtcaattttataataagcacaatgtggtactgagaagaatgtatattctgctgattaggggtggagagttctatagatgtctattaggtctgcttggtccagagctgagttcaagtcctgaatatccttgttaattttctgtctcattgatctgtctaatattgacagtggggtgttaaagtctcccactattattgtgtgggagtccaagtctctctgtagatctctaagaacttgctttatgaatctggatgcccttgtattgggtgcatatatatttagaatagttagaccttcttgttgcattgatccctttaccattatgtaatgcccttctttgtctcttttgatctttgttggcttaaagtctgttttatctgagactaggattgcaacccctgggttttgtttgtttgtttgttttctttatatttgcttggtaaatcttccctcatccctttattttgagcctatgttgtgtctttggacgtgagatgagtctcctgaatacagcacactgatgaatcttgactctttatcccatttgccagtctgtgtcttttaactggggcatttagcccatttacatttaaggttaatattgttatgtgtgaatttgatcctgtcattatgatcctagctggttgttttgcctgttagttggtgcagtatcttcataatgtcgatggtctttacaatttgatatgtttttgcagtggctggtaccagtttttcctttccatatttagtgcgatgatcttacaatttggtatgtttttgcactggctgatactggtttttcctttccatatcttgtgcttctttcaatagctcttgtaaggcaggcctgctggtgacaaaatgtctcagcatttgcttctctgtgaaggattttatttttccttcgcttacgaagcttagttttgctggatatgaaattctgggttgaaaattcttttctttaagaatgttgaatattggccctcctctgttctggcttgtagggtttctgcagagagatccgctgttagtctgatgggcttccctttgtgggtaacctgacctttctccctggcttccgttaacattttttccttcatttcaaccttggtgaatctgatgattatgtgtcttggagttgctcttcttgaggagtgtctttgtagtgttctctgtatttcctgaatttgaatgttggcctgtcttgctacattggggaagttttccaggataatatcctgaaaagtgttttccaacttggttccattctccccgtcactttcaggtacaccaatccaatgtaggtttggtcttttcacatagtcccatatttcttggaggctttgctcagagaggaggaactcagagaggcagtctggctatagcagatttgctgagctgttgtgggctctgcccagttcaaaatttttggcagctcctttactcaagcctcagtaatgttggatgccccacccccaaccacgcttgagcatcccagggcaacttcagactgttgtgcctgcagtgagaatttcaagcccgtgaatcttagcttgctaggctccatgggggtgggatctgctgagctagaccacttggctccctggcttcatccccctttccaggcgagtgaaaagttctgtctcactggcattcctggcaccactggggtatgaaaaaaaaactcctgcagctagcttcctgtctgaccaaaccgttgcccagttttgtgcttgaaacccagggccctggtggcataggcacctgagagaatctcctggtctgtgagttgcaaagatcgtgggaaaagcatagtatctgggccagagtgcacagttcctcaaggcacattctgtcgtggcttcccttggctaggggagggtgttccctgaccccttgcacttcccaggtgaagtgacaccccaccctgctttggctcaccctccatgggctgcacccactgtctaaccagtcccgatgagatgagccagatacctcagttggaaatgcagaaatcacccgtcttctgcattgatctcaccgggagctgtagaccacagctattcctatttggcctttttttcttttgagacagggtttcactcttgtcacccaggctggagtgcaatggtgcaatcttggctcactgcaacctctgcctcccaggttcaagtgattctcctgcctaagcctcccaagtagctggcattataggcactcaccaccatacccagctaatttttgtatcttttgtagagatggggtttcaccatgttggctaggctggttttgaactcctaacctcaggtgacccacctgcctcggcctcccaaagtgttgggattacaggcatgagccactgcacctggccaaatgttgatttttttaataccattttataataaaaggaacaaggactccctggagaaacagctgatactaaggcaggagtagaaaatatacaagataatcctggaaaatcttgtagggccagaaagtaaacaagtgcattaaaaataagtcacattggtaataatatgtcaaaggaacaagggagtctactgaaagagctcccaaaggccaaagctggaagaagtagagcaagaaagtaaactagctttgaattataacccaaaatataaagtaaatatccataagtctctactgatataaagcacaattgaataataactgggagagggagggagaataaataagttctacgtaaaagaatttcttataaattttgtagatatgactttctaaacaaattctcattcttaagaattcatagtgacttccttccaaaaattacaatatggaaaactgataaaaaatgagtaactctacagtggaggaatctgacacatactacatcagccaggttattgaggtcaacatcaacagccataaatcatgtgaacagtatgtacacttggtatgatgtaacgaatagcacttcacttctgtggtctttctccccaggctcattatctcagtataatcatgaaaaaaaaaaaaaaaaaaaaacccagcaaagtccaatagaggaatattctacaaaatacctcactatactctttaaaagagttaaggtcattaaaatggagtcggagacaatgtcctcaacatgaggagtctaaagagacaggccaactaaatttagtatggtatactggatgaattcctggaacagaaaaaaggttattaggtaacaactcaggaaatctgaataaagaaagaaatcagttaataacaatgtatcagtattgctttattaattatgacaaaagtaccatactagtgaaagatgaataatcggagtaactgtgtgcaaagactgggtagaggggttattattaaaattttcagtaccagctgctcaattttcctataaacctaaaattgcttttaaaaataaaatttgttaatacaaaatgtaatgtattatcattgagaaaatttgatacataaaagtattaatttatggtatagctccgaagtataatttacgttttggttgttattttataaaatcattaatttcagggcttctttaaagatgaactgccccagttagcacatccacaatgtgattttatttacaaattttttttgcaattatataattctatagtgttataactgtggggcgaattgagaccttcctgaatggaaatgattgacatagaatttttcaatagaatccagctatggattttttgtatatatgacgtttagaggaatcaatttattggaagtttacacatctctccatccttgtagattatcatgatcagtgacaattatatgtacactgaatctgttataaaataaatcattattttttaaagtagtgatataaacttaaatcctgacctgttaatgcattaaaagtgaattatgtaaattgcttaatttctatatatttttcttatctttaaagtaggtgattaagaatactcacttctgcttttcttttagtataaattaagacaatcagtgtaaaactcttagcaccaatcttagcatattttaatattagctgttgatattattattgtcttgcagtgcctacaacatgtaatgattaaaaacagcataagagattaataataattcacatttgcacagaaccttagggcttttaaaatacttgatgcatgtgaaatcacttaaaaaccctctaatgttttctgcaaatataggaagttaatattgtcttgggcttttctgaagctctctcaaacctcacagtagttctgtgaggtcttcagggaaaatatttgactttattttatagatgaggaaactgagattcagaggatatactaggtccatcacttccaccgatgatgccatcttggaaaaattatttaacctctctaagtatcagtttcttcatttgtataacagtgtatactgccatttacttctaggctggtcattgagtaagctaatgtacattatgcagttagctttatgcctgatattctaaaaatgctataactgtttttgttgtgtgtcttattgtctgtttttctatagcttcatttaacctctcagggcagtcatagagttggtggataatcaaaacaagaatcaccatttaatttttatcattcaagactgagttttggcagagacttacggcttccagattggggttttatttatttgcttgagcatttactaaacagttttaataaccaagctctggatgaggtaaagtggcctatggaaagataaatgcaacctaaatttgccctcaaggagatgatacaatgtataaataacttaaagaccaagtagggagaagatgtaaaaagtttgcaggagcagactttaaaactttaagatcactttaaacttgtaacagaaaagaaagcaggcaagagaaggtgacatttgaatgggaccttgaacaaggagtaggaattagcatggtgtatatttgcatgctgggaatctacatattggatggcagattgcatttcgttctttcaatcattatcagtggaatcattcataacaaaagtagagagtctgttctgctaatacatgtgcttctgtaacacaaattagtttccatgcagttgtaaatagggaatgatatcagttaaacataaagtgatgctggagtcatacttgctttttcttaaataggcaagtgaagatggaatgaagggagtagaataacaacctttagtggggggaaaaagcctttagtaagttcttctgctggatatgcaagagacttttaaactccatttttaagaaaattaaaaataaacaactgtatccaacttcctccccaaagaggtgcaccccaaccttgcagagctcttgccttgtagcaggttgtacttcttcccatgttcaccttaacagcagcccgactggctcagaacttctattctatttgcattgtctcagagcgcaagaaaacatttacattttattgtttcttgttcctttctagttgctggaaggcagttcaagtaactgccttagtatcaattgttattatttcgaattggttatgaagttgaataagtttggagtatccttaaccatactttttctgtaagtactgttatttttaaatatgttattttgcagaagacaaagtttttttcagaacacatgtatcatgttacaccttagcctttgacaaaagggggtcctgggcccctggctttagaaaacccacctctggccctcctcagggtaaacagttcatgggggtaggagaatgtgcctacagggagctcatgcatccttcttctagaatatgtttttggtgcctagacttgaaattccctgatttcacttgcagagtctgtgtgggttctttctgattctctccttccaagggcagatcatgctgccagaatggaaatccctggatctgaagaatattaaaggggcagttatttgaagtgaaatggagatggttgtatgtgaaagaaaggtgggcaggccagggattgaaggatggaagatgactctccccatgctatcattttctctttcggggctccatagactttgggaattcagaattcaaacctgatgtcccaggtttttgtgaggatatatttgtccatgtagaaagaaagaataaatttatttcatagttaatgtgcgatatgagatttaaatgtctatttgaaatcttactgtggactctgccaatgttagaggcaggcctgactaacaataaaagtactcaggctaaatgaattttaggatttcttttctttttctgtaaaaaatgccattgagattttgataggaattgcattaaatctataggttgcttcgggtagtacggccattttaacaacatatgccttccaatccatgaacagaggctgttttccatttatttgtgtctactttaatttatctcatcaatgtttggtaattttcaggtacaagtcctttttagttaagtttattcctaagaattttatctttttgatgatattatagatgaaattattttcttaatttccttttgggatagtttattgtttgtgtatagaaatgcaacatttttgtatgttaattttgcaccctgcaactttattgtttattagttctaatttttttttttggtggagactttctatatataacatcatgccatctgcaaagagagatcatttacctcttttttctgatcctttttctttctttcatttttctcttcctgcctaattgctctggcttggcaaacaaatggccaacaggcatatgaaaagattttcaacattactaatcatcggtgaaatgcaaatcaaagccttaatgtgatgttaggaagtgtcaaagacaaacaaacaataaaacccaaacccaaaagatcacaagtgttggtaaagatgtagaggaatttgaacctgtatacactgttggtgggaatataaaactgtgaagctgttatgaaaaacattatgaaggtttcttaaaaaattaaaaatagaactaccatatgatcccacaatctcatttctggatatatatccaaaggaaatgaaatcagtatgtcaaggaggtatgtgcattcccatgcctattgcagcattattcacgatagtcaaggcatggaaacaacctaaatgttcatcaacaggtaaatggaaaaagaaaatatggtatatatgaaacttcccaatgggttcactttgcctgttgcctagacagagtcaacttatcaagacaggggaattgcaatagagaaaaagtaattcacaaagaggcagctgtgtgggagaccggagttcttacgcaaatcagtttccagcattaggggatcacagtttttaaggacaacttggtggatgggggaagccagtgaaccatcagtgctgattagttgattgatcaggtcagagatgaaatcacagggagtcgaagctgtcttcttgcactgagtcagttcttgagtgggggccacaagatcagatacgccagcttatcaatctgggtggtgccagctgatccatcaagtgcagggtctgtaaaatatctcaagcactggtcttaggttttacactagtgattttatccccaggaacaatttggggagggtcagaatcttttagcttccagctgcatgactcctaaagtatactttctaatcctgtggctaatttgttagtcctactaaggcagtctagtccccaggcaagaaggaagtttgttttgggaaagggtcactatcgcccgtttttttgtttttgtttttgttttttttgagatggaatcttactcttgtcgcccaggctggagtgcaatggcatgatcttgcctcactgcaacctctccctcccaggctcaagcgattctcctgcctcagcatcccgagtagccgggattacaggcgcacaccaccacgctcagctaatttttgtatttttagtagagacaggggtttcaccatgttggccaggctgctctcaaactcctgacctcaggtgatccacccacctcggcctcccaacgtgctgggattacaggtgtgagccactgcacccagcatcacctttgttttaaactacaaactaagtttctcccgaagttagttcagcctacgcccaggaatgaacaaggacagcttagagattagaagcaagatggaggttttttttttttgagatggagtctcgctctgttgcggaggctggagtgcagtggcgtgatctcggctcactgcaagctccgtctcctgggttcacgccattctcctgccccagcctcccaagtagctgggaccacaggcacccgccaccacgcgcgctaattttttgtatttttagtagagacggcgtttcactgtgttagccaggatggtctccgtctcctgaccttgtgatccacccgcctcggcctcccaaagtgctgggattacaggcatgagccacgacacccggcccaagacggagtttgttaagtcagatctttcactgtctcagtcataattttgcaatggcagttaagacattatgctaaatgagataagctagtcacagagggaaaaatatggcttgattccacttatatgaggtttctaaaatagtcaaatgcatagcagcagggagtagaatagttgttgccaagggctggggggaaggagaaaatggggagatgctattcaacaggtataaagtttcagttacgcaagatgaatgagttctagagatctggtgtatgatcctgcaactgtagttaacaatatagtgttgtgtcacaatttggttaagaaggtagaccttatgttaagtgttcttagaacaataataataataataataaccatactaagaaattggacattggaggcataaactttccatctggtttgaatgaacctccaacttaagtagtaatgtgtaatagatttaaggaaaatggtaatataaattagaatggttattttcaatgatttatgaagccctgtagaggaggttgttattattatcattgccattattatgctgctaatgagtagcttcgtctttaactactctgtgaccttgggcaatttacttcgcgttttgggaagaagttcttacctgcataatatgaagaggctgaaagaaaagagttttcgggttttccctccaacacttatggtattttattatcttttgcaaaaatgtgtttttttccctgtctgcccctttttatatcagtagggtctcctttatgaattttcattccctatagtttttcttactgccttagtccttttcttcaaactcagtgctatacaaaccaaatttgcaatatataaagctatctctaaggactctacataaaacaatattcaagagctttaaactcagagtgacatttaaggatagaaacagccagataaaaagataagtttctgatttactctaaaatgtattctctgaatctgcatttctgaagtctagcagaaatggttgcttcagtcattatgcgtggcaaggtaaaagctccaacgccaggagaatttaatccaagcttttccttggttctgtgagctacagaattgtttctcctttcctgatgatgaactttcccgtgaattctctttctttgtgacttacatattcatggcgacagcccttaccttccaggttagctaatggcaagaacgtggtgacagattctactgctgaggaatgttagtgggttgggtagtgaaaggttatattcaatcaattcagcagaggatctttagcagccagagtgctgttgacactcaattacattaggaaaagagacacgatcaacataagattaaaatataagaaatatatcaaaatgagaacaatataggagggatcatgaaatccacgaacagaaatcataaattgtgtgtagcgctttaacagaaatgacggaggattaaaaaaggctagactatggctcttactcttgagcttcaaatttagctgagacgactagccattcataaaataattaaaacaaaaaaaaagaagtaatgtgtgataaggaggagtttataaatttggtgaagaagttgtacattgtggaaattgtggaactgtacatcagggaaagtgtagaattgttcattatggaaagaaacttggacttgaagaaaaataatttcatcaaaatttctaactaatctttcccagtattaaactgccttatccattcattttgattacttattcatttagttttttcaattgttgcagagtgccttctatgtgctaggcaatattcttggtgctgatgaacaaaatacaaatttaatggtgagattaaaaaatgagataaataatatgtggatgatgtgaagttctacagaaaaagaaaatgagcagggaaaggaacagggagcttgtgggaaggtgacattcaagcaaacacctagaggtggtgtgggagttagttatgtggatatcttagggaaagacagccaaggtagaggaaaaagccagtgcaaaggcactgacacaggcatctggctggcatattcaaacaataccaaagagataaatgaggctggagctgaaggataaagagaagggatagtagaagacacgaggttgaggggtggaggacaggacagtcagatcatttaggacttggaaaaggctggcaggaatttttacttcttcttttttttctttttttgagatggagtcttgctctgtcacctgttgcccaggctggagtgcagtggcccgatctcggctcactgcaagctctgcctcctgggttcatgccattctcctgcctcagcctcctgagtaggtgggactagaggcgcccgccaccacgcctggctaatttttttttttttgtatttttagtagagacggggtttcaccgtgttagtcaggatggtctcaatctccggacctcgtcatctgccctcctcagcctcccaaagtgctgggattacaggcgtgagccaccgcacccaacgaagaatttttatttctatcattattgtgtttatgcttggaagccattgaagggttcttaggagaatgttatggtctgacttatgctttaaagggtcactctggctgccttgttgaaaataacgctgtacaggaacagggagactgtagaaaccattcatgagtatattagaataatccagctaagacatggtggtagcagtgaaattaatgaaacagtggctagattctgggtatattttgaaggcagagacaaaataatttgctgacagattacaaatgtggtgtaaaagaaagaaaaaaaggatatcaaggtttttagtgtgtttggacatcattttgaagagacaaaatgtgaagacagtgtaatcaagaagtatatatatttcttaaaacattcagatctggagttcatatagcaagttttctttggtatgcagtttggagccaagacacacaccacttcagtttatttacgaacattcagtagtgacccatgtagacttggttggagtatggttgtttttggtttgctttgttttgtttttacaagtactcaaacttttatgacagattagttgaggcaggctttgccattctgtctctctctctctctctcattttaattaaacttttttgtttcagataaatatagatttacatgtagttttaagaagtaatacagagatatcctgtgtaccttttactcagtttctctcaatggcaacatcttgcagacttatggtatgatattacaaccagaatattgacactgatacaatcaagctacaaaacaattccataaccacagtgaactctagttttaggtgcccttttatagctgcattggatgctggatttttctcaacccctttgatggacttgcgacaggggtgcccctttactgggctcaccacgctcaaccccttttaggagggagcacgtgagcgagcaagtgcaggatccagccagccaccactctgggcactgggaggagcaggctctgtttactcagagcgagcaaagccagccactcgactccagcagaaacaagttctatgtggggcccacagtggtgcccaggtgcaaccccaaagccccagagggtgtgttacaatgctcttagctctgctgtctgcagatggtgctgtgttatcagctccgttgaccccttgcctcatcatgtggggtggctgccctcccctggtaagggcaaagagccagtatgacaggtttttttgagtacccacactcagtgggtcctgagctctcgtccggcatccaagaagaatgagatcgtgtggacacttgaaggatggcgaaggtggagaattttatttagcaatggaaatggctcttagtggagaggggagctggagagagggtgggcctgtcaggtagtcttctcccgaagtccagccatctcttccccgaagtccggctggctctcctctgaagtccagctgtctcccggaagccaagttgcctcgctccagtcaagccaccctctatcctcttttgactgagtctcaggtctttataggcacagaatagtgggggaggtaggccataggtagtttaggaaaaggcaacattggattggcaaaaaggcattattcagaaagagccaattgggagagagtgggcaagcaggattagttctcaccttgggctgggggtttcaggctgtttgccttcaaggtggggcttcactggggatctgcccctgtctgcctaatgcctctatcacgtctacttccctttcccctctccctgtccttaaaccttgacaactatagcctctttttaaaaaaaattattattataatttaagttctggggtacatgtgcagatgtgcaggtttgttacataggtatacatgtgccatggtggtttgctgcacccatcaacctgtcacctacattaggtatttctcctaatgctatccctcccctagccccccattttccaacatgcccttgtgtgtgatgttcccctccctgtgtccatgtgttctcattgttcaattcccacttatgagtgagaacatgtggtgtttggttttctgttcttgtgacagtttgttgagaatgatggtttctggcatcatccatgtccttgcaaaggatgtgaactcatccttttttatggctgcatagtattccatgatgtatgtgccacattttcattatccagtgtatcattggtagacatttgggttggttccaagtccttgctattgtgaatagtgccacagtacatgtgcatgtgtctttatagtagaatgatttatagtcctttgggtatacacccagtaatgggattgctgggtcaaatggtatttctagttctagatccttgaggaatcgccacactgtcttgcacaatggcttaactaatttacattccaccaacagtgtaaaagccttcctatttctccacatcctttccagcatctgttgtttcctgactttttaatgatcgctattctaactggcatgagatggtatctcattgtggttttgatttgcatttgtcaaatgaccagtgatgagcttttttttcatatgtttattggccacataaatgtcttcttttgagaagtgtctgtttatatcctttgcccactttttgatggggttgtttgttttttttcttgtaaatttgtttaagtttcttgtagattttggatattagccctttgtcaggtggataaattgcaaaagttttctcccattctgtaggttgcctgttcactctgataatagtttcttttgctgtgcagaaactctttagtttaattagatcccatttgtcaattttggcttttgttgccattgcttttggtgttttagacatgaagattttgcccatgcctatgtcctgaatggtattgcccaggttttcttctaggatttgtatggttttaggtcttatgcttaagtctttaatctatcttctgataatttttgtataaggtgtaaggaaggggtccagtttcagttttctgaatatggctagccagttttcccaatgccatttattaaatagggaatctttttcccattgcttgtttgtgtcaggtttgtcaaaaatcaggtggttgtaggagtgtgatgttatttcagatggttgtaggagtgtggtgttctatttcattcgtctatgtatctgttttggtaccagtaccatgcagttttagtttctgtagcattgtagtatagtttgaagtcaggtagcatgatgcctccagctttgttctttttgcttaggattgtcttggccatgtgggctcatttttgattccatataaagtagttttttccaattctgtgaagaaagtcattggtagcttgatggggatagcattgaatctataaattactttggccagtgtggccatttcgacggtattgattctttctgtccatgagcatggaatgtttttccatttgtttgtgttttctcttattttcttgagcagtggtttgtagttctccttaaagagctccttcacataccttgtaagttgtattcctaggtattttattctctttgtagcaatgtgagagtgagttcactcatgatttggctctctgtttgtctgttattgatgtataaaaaagcttgcgatttttgcacactgcttttatatcctgagactttgctgaagtcacttaccagcttgatgagattttgggctgagacgatggggttttccaaatatacaatcatgtcatctgcaaacagagacaacttgacttcctctcttcttatttgaatacctttatttgtttttcttgcctgattgccctggccagaacttccaatactgtggtgaataggaatggtgagagagggcatacttgtcttgtgccagttttgaaagggaatgcttccagcttttgcccattcagtatgatattggctatggatttgtcataagtagctcttattattttgagatatgttccaccgatacctagtttactgagagtttttagcatgaaggggtgttgaattttgtcaaaggccttttctgcatctattgagataatcatgtggtttttatcttcagttttgtttatgcgatggattacgtttattgatttgtgtatgttgaaccagacttgcattccaggtatgaagctgacttgattgtgctggaaaagctttttgatgtgctgctggatttggtttgccagtagtttattgaggattttcccaccaatgtccatcagggatattggcctgaaattttccttttttgttgtgtctctgccaggttttggtaacagaatgatgctggcctcataaaatgagttagggaggagtccctctttttctagtgtttggaatactttcagaaggaatggtaccagctcctctttgtacctctggtagaattcggctgtgaatccatctggtcccggactttttttggttggtaggctattcctcaatttaagaacttgttattggtctattcagggatttggcttcttcctagtttagacttgggagggtgtatgtgtcgaggaatttatccatttctgctagattttctagtttatttgtgttgaggtgtttatagtattctctgatggtagtttgtatttctgtggaatcagaggtgatatcccctttatcattttttattgtatctatctgattctgctgtcttttcttctttattagtctggctagcagtctatctattttgttgatgttttcaaaaaaacagctcttggatttattgatttttttgaagggatttttgtgtctctatctccttcagttctgctctgatcttagttatttcttttcttctgttagcttttgaatttgtttgctgttacttctcaagttcttttacttttgatgttagggagtcagttttagatcttccctgctttctcttgttggcatttagtgctataaatttccctctacacactgctttaaatgtgacccagagattccggtacgttgtgtcttcgctgtcattgctttcaaagaacaactttatttctgccttcacttcgttatttacccagtcgtcattcaagagcaggttgttcagtttccatgtagttgtgtggttttgagtgagtttcttaatcctgaattctaatttgattgcactttggtctgagagactgtttattatgatttccattcttttgcatttgctgaggagtgttttacttccaattatgtcatcaattttaaaataagtgcgatgtggtgctaaaaacgaatgtatattctgttgttttggggtggagagttctgcagatgtttatgaggtctacttggtccagagctgagttcaagtcctgaatgtccttgttaattttcttctcattgatctgtctaatattgacagttgagtgttaaagtctcccactattattgtgtgggagtctaactccctttgttcatctctaagaacttgctttatgaatctgagtgctcctgtattgggtgcatatatatttaggatagttagctcttgttgcattgatctctttaccattatgtaatgcccttctttgtctcttttggtctttgttggtttaaagtctgttttaccagagattagaattggaacttctgctttttttgcttttcttttgcttgataaatattttccatccatttactctgagcctatgtgtgtgtttccacatgagatgggtctcctgaatgcagcacactgatgggccttgactctttatccaatttgctattctgtgtctttaagttggggcatttagcccattcacatttaaggttaatattgttgtgcttgaatttgatcctgtcattatgttcctagctggctgttttgcctattagttgatgcagtttcttcatatttgtgatgttctttacaatttggtattttttttgcagtgattggtactggttgttcctttccatgtttagtgcttccttcaggagctcttgtaaggcaggcctggtggtgacaaaacctctaagcatttgcttctctgtaaaggattttatttttcctttgcttatgaaacttagtttggggatgtgaaattctgggttgaatattcttttctttaagaatgtcgaatattgaccctcttctggcttgtagagtttcgcagagagatctgctgttagtctgatgggcttccctttgtgggtagctcgacctttctctctggctgcccttaacatttttcctttatttcaaccttggtgaatctgacgattatgtgttttggggttattcttctcaaggagtacctttgtggtgttctctgtatttcctgaatttgaatgttggcctttctcactaggttggggaagttctcctggataatatcctgaagagtgttttcctgcttggttccattctccccgtcactttcaggtacaccaatcaaatgtaggtttggtcttttcacatagtaccatatttcttggaggctttgttcattccttctattcttctttctctaatcttgtcttcttactttatttcattaagttgatcttcaatcactgatatcatttcttctgcttgatcaattcagctattgatacttgtgtatgcttcacaaagttctcatactgtgtttttcagctccttcaggtcatttatgttcttctctaaactgcttattcaagttagcaattcatctaaccttttttcaaggttcttaacttccttgcattgggttagaacgtgctcttttagcttggaggagtttgttttgtttttaaccaccttcataagcctacttctgtcagttcatcaaacttactgtctgtccagttttgttaccttgctggcgaggagttgtgatcctttggaggagaagaggcattctggtttttggaattttcagcctttttgtgctggtttctccccatctttgtggatttatctacatttggtctttgatgttggtaaccttcagatgaggtttttgagtggacgtgctattcctttctgtttcttagttttccttctgacagtcaggctcctctgctgcaggtctgctggagtttgctggaggtccactcccaactctgtttgcctgggtatcagcagcagaggctccagaacagcaaatattgcttcctgctttttcctctggagactttgtcccagaggggcacctgccagatgccagtcagagctctcctttatgaggtgtctgttggctcctactgggaggtatctcccagttaggatacatgggggtcagagagccacttgaggaggtagtctgacccttagcagagcttgaacactatgctgggaggtctgctgctctcttcagagctgtcaagcagggatgtttaagtttgctgaagctgcgcccacagctgccccttccccaggtgctctgtccctcaggtgttctatcccagggagatgggggttttatctataagtccctggctggtactgctgcctttttttctgagatgccctgcccaaagaggagaaatctggcagtctggccacagggtccttgctgagctgcagttggctccacccagttcgaacttcctggtggctttgtttacactgtgagcataaaaccgcctgcccaagcctcagaaatggcggacgctcctcccccaagcaagcgtgagcttccgagttcgaactcagactgctgctgtgctggtagcaaaaatttcaagccagtggatcttagtttgttgggctccgtgggcgtgggacccgccgatccagaccacttggctccctggcttcaacacccctttccagggaagtgaaaggttctgtctcactggtgttccaggcacaactgggatatggaaaaaagaaaaatcaaaaaacaaaactcctgcagctagtccggtgactgctcaaatggatgcccagttttgcgcttgaaacccagggacctggtggggtaggcaccagagggaatctcctggtctgtgggttgtgaagaccatgggacaagcacgatatctgggccggagtgtgcacagttcctcaggctcagtccctcacagtttccctcgggcaggggagaaaattccctgaccccttgcacttccccggtgaggcgacgccccaccctgcttcagttcaccctctgtgggctgcacccactgtccagccagtcccaatgagatgaactggatacctcagttggaaatgcagaaatcgcccgccttctgttttgatctcgctcggagctgctgaccacagctgttcctgtttggccatcttgccagcaatcctgcctctctgtttatatcacacttagaacactacaatcactttaagaaagaaattggtgacattgaaatgtgtttagagaagaactgtttagaatcagggggaagcacaaaaacatgacatatgaagaaaaataaccaagaatacagtatttatcacaataaaaatcaagctcagggtaaaatatatagctctccatgattttggagtgctcccatgtgtctgaggacttagagttgttctgtaagaccaacagatatagtgttttttttttttttttaaagggattccatttcttttaggaagaattttttcagatttaggaaatattattaatacttccaggaggttttttttttttttttttttttttttagatagagtctcactgtgttgcccagctcactgcaacctctgcctcccaggttcaagtgagtctcctgcctcaacctcctgagtagctgggattatgggattacaggaggagcctgtcaccacagccagcaaatagttgtatttttagtagagatggggtttcacaatgttggccaggttggtctcaaactcctgacctcaagtgatccccctacctcaacctcccaaagtgctggggttacaagtgtgaaacactatgcctggcctttctttcaggaggtaagttctctctttgttcagctgaagagagtttaagcaatcactatgtaataactcaataattttctggaggtttgaacttcataatttttttcaatgataacatagaaaatattttttccttttgcttcttccagtggctttatttagtttattttttaattgaaaataaaactttgtgtgatactgtagataagatacagctgtaaaaaataatacagaaagctcctaggtaccttttgcccagtttctcccaatggttacgcttgtcaaaattataagaactaggatattgaccatgataaaattcagcaatcttattcagattttccaagttttatttatacttatgtgtgtgtgtgtatttgtgtgtattaaattttataccgttttattacgtgcaggttcttgtatccactgccacagtaatgatactaacagttccaacaccacaaggatcctcttgttgcctttttatatccacactcacctcctgcttgccaccctccttctccaacccccactccccatcccctaactcctgccaactactcatctacctccatctaaattatttttcatatttcaaaatgttacataaatgaaattaacagtgctatgtagccttttgggattagcttttttcactcaacataattttctgaaattcatctaagttcttgcttgtatcaatagtttgtttcttttattgctgagtagtattccatggaatgtacttgtcacagtttgtttaatcattcatgtgttgaacatctgggctgattccagtttttagctattgtaaataaaactgctatgaatatttgtgtatgggtttttgttttggtaaacataaattttaatttctctaggaagtgtctccaggagtgcaactgctgggtgttattgtggttgcatgtttagttttagttttgttttgtttttgtttaagaaattgccaagctgttttccaaaatggccagaccagtttacattccctgtctgtctttttaaacattgtagtttatcttctgtttgtggaatcttagctgggctaaatgaatcccagtgtgggaaggattttagaaaccttgccaagacacaaaaaataaagtatgttctgaactaatctgaagaagagaaaatcttgtttaactaaacctgtctatgtaacaaggtcataaaaaaggctacacaataagagagaggatcgttcttttggattttcagagaagcctttgttaaaattccacatgacccaatgctacttaaaaccaaagtcatggggattaaaggggaaatataaagaatcaaaaatctaattcacagtgagttacgcaggctgctttgtgcctggattcttgtgtacttacagctgtctacagcacattccatctagagttgctagatgctctcctttaaggtgttagctttcccagacatgctttgatgtcctagcagtaccaacgtgggcagagtgtcatgggctgcaaggaaatgggagaatgctgacactttctttacatcctatcaggactctttggaatgaaagatacattttagttattgttttcattttgagaacaataagcacatataattaattatgatatttacagttatagccaccattttgagtttctaccatgtgccaggatctgtgctaaattacatacattatatacagttctcaaaatcagccttcaaagaaggtatttttttagatctccaatttataaatgagggaggttaggtcatcaagtttaaccacatatattcattagactactatgaaacaaattcaaaatttttattaatttccatgctaaggaattctaaatgcccagtttcacctatgacttctctatctaccgtgattcattactgactgctgggggcaggggaagaattaggaggatgggtagtagaggtagagtggcttaaggtacacaaatataataatcataattataatcatattttaattatgccatcatttattgagtttctgctatgtgctgggatttctgctaattttgatatataaggtcttgacttcaaacaaaaataatcttgtgtaaaacagtcacgtaaatacatgaggaaacaggcttagaaaggtgaagtgatttttcataaagtcacacacctggagaaaattctaagattcaatcagtgatctacctgactctaaaattattgctctgtttgtttgcatatctctatgtatgtatatcaatggaaaacacacacccacacccacactcactcatacacacacaaattcgttattagagaaattaagattcttggtgatatggtttggctctttgtccccacccgaatctcatcttgcagctcccgtaattcccacatgttgtcagagggacgtggtgggagatgactgaatcatggaggtgggtctttcccatgttgttctcatgatagtgaataagtctcacgagatctgatggtttaaaaatggtagtttccctgcacaagctctctctttgcctgctgccatccatataagatgtgacttgcttctccttgccttccgccatcattgtgaggcctccccagccatgtggaactgtaagtccattaaattgctttttctccccagctttgggtatgtctttatcagcagcatgaaaacaagctaatatggtaaattggtaccagtagagtggggtgctgctgaaaagatacctgaaaatgtggaagacattttccccattgtcttgaggattaacattcggctccttataaattatgcaaatttcagcagtcagcttgaatttctccttagaaaataggattttcttttccatcgtgttgtcaggctgcaaattttccaaactcttatgctctgcttcccttacaaaactgaatgcctttaacagcacccaagtcacctcttgaatgctttgctgcttagaaatttcttctgccaggtaccctaaatcatctctctcaagttcagtgttctacaaatctctagggcaagggcaaaatgccaccagtctgtttgctaaaacataacaagagtcacctttctccagttcctgaaaacttcctcatttccatctgagaccacctcagcatggatttcattgtcgatatcattatcaacattttagtcaaaatcattcaacaagtttctagggagttcaaaactttctcacatttttctgtcttcttttgagccctccaaactgttctaacctctgcctgttacccagtttttgtggctggtaagtctgatggaaaactttgggtagttgtcttcaacagttaacagaatatagaagaataggactagtgcagtatcatgctcattgacctggttttttcatgttcatcaatctctcctcagtctcaaccattcccctttctacttatttactacaaaatttctttgtcactgatggatcaacactcctttacttgtagctggtggtacataattcccactatctattatataggagctccatactgtctctcactttatattttcttcataatagacacttattaaatatttgaatgatgaatgaatgaaatattagaattttcccttccacactatttaccttcttggtatcaattgctctttaatgttttcaccatctccgatagctcctttcaagaatatctgatttaaaaggtaattccctgtgtttaaaattgagcattctgtttagttcagtttaatagcatgtagtaatttagcctttaagcggggaaccctgttaggtgctcagggcaaggagatgactaacacatcacctgacttttaaggagttccctattttctagaggacacaaatgagtatgataagggcagctagagaaacctgcacaagaaatgaaggaaattcatcgtatcggatcaccagaagagatggacaaagatggctttccacaggggatgatacctaacctggattttgaaagatgaataagagttttcctttttagatagatgagcaaggactatcttaaatagaaaacatttttgttcactgagttagctctggaaattgcaggaaatgttacgtggattttggggatctaggctcagaatcaaaacctgggttttgatgtattaggattgggagtttcacctttacagcatgacagggagagaagtggttgatacaagtaacaacttttataaacaatggctgcttcacattttattctaattcctggatgaacctgggcaaaaaaatgaacagaatagagatctttgtggaatacataaataaagctatattttaaaatggtttgaaattatgagtttaaatctaaactttctcaactgaaggcattaaggtgtttcatcttcttcttgttgcttcactgtgggtagggtgcatattaaaagtgcacaactttaagaagttgaaggacttagtttgtcaaaaagcgtaaaaagcccctccatcaactctaaggattattatatccttagtagaaataattgcacgtgcccacactgatagtggaatgcatttcctggagtgctgcattgagatagattctgaggcaatatcaacattcataggaaaaagccctatgatcaattgttcacatgtgtatatacgtgcatgtgtgtgttgctgggggcagaggggattgtgaaccatgtgctgcatttctgccatctctcaatcagaaaaataatgaatgggtggccacaataacttgggaagcctgatcaccttattttttaataattataccccatccatacccacattgtattttcatcaaattaataaaagatgattttgcagtgtccttttttgtcatagtattaacattctcacaagcacaaccataaaatcagttgacatttactcttaatttacacagaataatggtgttggttaaagagtgattacatatgaagtttaatacacagttattttttacctggctctctattatctatcttttatatcaggaaagcaatttaatttggtgagatatccatgtagataaccaccatagcttgcacttacagcttgataatgccctatagggacttctatacaaaggagaaggcactcaataaatacacatgaaatgaaagaataattccgagtcatatgacagggggaatgtgaaggaggctaaaaatgggaaagaattaagataagattcttaagttgaatttatgtggcataaatgaaatacaggatggcgaagggtactccactgttttattgccacttcttgcagaaggcctgtgtaattcatttaatgcttccctttttgtgacttatgctgtcatcccagattcacaataatgtaagtttacagcactccatatcgacatatattctctctccactgtgtttgcaaacttctctactcctgctgcgttcctaggggagagggttaattcccaaaaggcaccacatcaggagatgttataagtggaattgttccagataagcaatgtcagtcatgcagtcatcctgatgtgcaagtcgaacctcttcatggacatgatactggtggtgtccaggaaactagggtgtggctaagactggaacagcataggtcaaactttgcaaaattaactgtgttcattttcattaaagtgtcttccttatatcctattctaatcagaaaaataaacattttattgattatggataaaatttagtgagtgctgtaacttgatcctatttaatccttcctaaaccctatcagttagtgatatggtttggctttttgttcctgtccaaatcttatctaaaattgtaatccccaagtgttgagggaggtgctgggtgggaggtgattggattataggggcggtttcccccatgctgttctcatgatagtgtgtgagttctcttgagatctgatgctttagaagtgtttggcagttacccctttttctcgctcgctctctctctcctgccgcattgtgaagaaggtacttgctcctccttcacctatctgccgtgattgtaagtttcctgaggcctccccagccatgcggaaccatgagtcaattaaacctcttttgtttatatattacccagtctcaggtactatctttgtagcaatgtgaaaacagatgaatacagttgactaccattattttctccagtttgcattttggaaaattgaaacttaaggagcataagtagttagtctaagattgcatagctgagtgtcatggtctagtttaaatcaaaggttgcctaataccgatgtttttatcatgctaatcaccatacagcatagccttctgtacagaaactgtggttgacatcttcccatttacctggctgatttaacagtccctcctaacagctgtctgcctggggagctgtgtcaaccctatagagcaaacattgggaatttagtttataacttgaacaaaatatctacatgtcagggagagtcccagagaaataagacactggtttattccccttaccctcctttttccagtcttttattctggtcttaaaactgcttagttgtaactaataaatgttactgggtgaataaatgttcacccaaaatactgtttttgacataaataatgtaatgtccaaacaatgcagaagctgccttaaataaaacatgtgaatgctgggtctttcttgtaataatttgaaaaatatcaataatgttgtcagtttaacaacaaaacatgctatctgcccttttcgtcttcctggctatattagaaaaagaaaaatgtgccccttcatcacataaaaagtatacttctcatcacaattgtcttaagagttgttctagaaacctacatttaattttaaaatgagcaaatgcaaatgaatggattagtaaacaagaatgtttgctggctttagaattaaataacatgaacttgaatctcagctgggaggctttgggcaacacccttaccttctttgaacctctgttttttcatgtaaagtggagataattatacctactacagaatgttgctgtgaggattaaatgagataatgaatgggtatcaatttgttaaccaatgtaaatttcatagtggtgcaagcaggaaagagctttattttgtttttccccccaacacgatctttaatttcttgctccttaaagctatctaattggagcccatggctgttgggaaccttcagtgataacaatcatttcatttggatagttgtcttaatttggatttcccctgaaatgatcttgagagaagaatatgggtgcagttagtctatctggaaagtgggtgcaggtagtacaagtgaagaaaagaggaaaagaggaaaaaataaaaaccaacaaaagctttagagcaggtcattactatgggtaactggggctccatctctctgaaataccacgtggaagataccttggaacattctctttggaagaaggggatgtaggagtgctgttggttccccaagtggatcctcttgtctgctctattgcacacatcccccattaccctgagcattgaatggctcactgctgccccctgctccttctcctgagaattgtttttagtttagcccactctcactccagttgccaagagcggatgaatgacagagacacataaggccagccctttgcctcaataggagatgattctgatgggtaatttaagctacagagcccttttctacccatgaatctggctagatggacctgtgatctcacactagcttggctcttttttcttccctcttctgttttattccctccttttactggtttctcctgaggcatctctatcactaaaactcatgcatgtgaatttctgtctcaatctgtgcttctagggaacttgacataagtcagggcaattatttaattatgctcatctcccactgcttgaggatttggaggcactgactagctgctgcctttgtggttcacaccacagcttatttctgttgcgggctcattgctcccttcatggagtgatattgggtgtggccccatcaggttggtctgagacaggtgaagattcttggtatacaggagacttgtcatgcttgctgtgtagacagtctccactgttgccctctcctctccctgttattggtgttgtctgcagccagtttaccatcttcagatggtaaactcagaaaacctcagaaaggaagtaaatagcagcttcttgttttgcttatgctcccatagttaaggaatacatgtaaacctccttcaagaattctgccaccgagttctgtcttggggaatggggataggttggggaacactaacatgtttttctgtccacccgcaagcaggctgccagggaatgaaaccttaatctacccatctgataatcagccttcgttcacttcatggaaatgccctaacttggtttgtgcaatagccactcagccaacaatttcctgattcaacaatctctcttaactctagtcttctgcctatatgagctggatgagatgatgggggtgtgggtaaaatgaccaatttggccaccttcttttttaaatatgaggttttctatagtctcttgggactttgggactttagttggtttccagaaggaacagaaagcattttaatattattttatagatgtaaattaaaacttagatgctcaccaagtggtagctcttagtttaattacaaaattagtctctggaatgtttgaaaagtcattgtttcttagtgttttctttaataaggtgacttagcatatttaataaaaaagaccacaggcctgagaagtaggagacctgggtcatcatgcttttagctctgtgacatttttaaataatttcaccttccaacagccaatacgtaggataataaaagttgtttaacatatcccacaggttgttgtaagtctgaaatgaaggaaaacacccaaaacatatttgaaagcaaaagataatgaaatgtcagttaataattaataaagtaactcaatgttaagggagcctatcaaaaggcaatttctcctttccttcagagacgctcacaccgatccaacaagccgccgtgactgagacctgactcgtttttggcaaacagatgccactctaaatgatgacaaagtgataaacctatgtaaatatttcatatggaagcaaagtcaatatggacaaatgtgaaagacatgattccaagactggaatgccaggctatgcatagacacagcaaaaaacaatgtggatattggagtagatcataagctgaaaacaaaccccatgctgttatttaaaagcttaccagaaacccctaaaaggcatgggccaggcataattttgtcattcttccctaacctcatcatgtcatatgctgtcaattgggtgaggcacagtgtagaaaaaagtgtcctgtgttctaattcctgctcctcctgaccttggatttgatgcttccttctccttgttctttgatggtcaaggtgtcatggtaatgtgtatctctgttcaaagaatagttatagatgatatgagatagtgtatgtgaaagtgttttggaaaagatagttattctgtagaggtataaggtaatattaaacaagtgataaaaaagatagaatgttctagaacagagtgagaaaatagcctggaggaaaggaagccagaagttgtcctattttatcacactatcatagactgcccaaaaggagcaaatgtctctgtcagagagagagagagagagagagagagagagagagagagagagagagaggagagactgctgtgcaagctaaagcttcgaagatttttttttttttttaaagacagggtcccaccctgttacccagtctggagtgcagtggagcaatcatagctcactacagccttgacctcctgggctcaggtgatccttccatcgcagcctcccaagtagctgagactacaggcacccaccaccatgcctggctaatttttatatattttctctaaaaatagggtctcaccatgttgcccaggctggtctcaaattcctgggcttaagtgatccacctgcctcagcctccaaaagtgctgggattacaggtatgagccactgcacccaggccctgaggacaaattttgtatggagtgggcattcatctgcccagtgccaccaagattgataacatctcacatgtggaggagcccttccaaatagcccatggtcaacacatgaaatcagccgtttaaatgtaaaccaatgacaagtcaaaccatttctgaaaaacaagaatttctttattatggaaaattccaaatgtataccaaagagacagaatagaatagtgaattctatacacccatcactctgcttcaatattgttaccattctaggaagactattcctttagaaatatattttttgatttaaaaattttatttggaaacaatgtcaaataagagtagtaaagaccattcctttaaaaatgtttttgattttaaaacttttatttggaaataatgtcaaataagagtagcttagatagaataatatagaaaattgtaacataagtagaataatttcaagtaagaacaagaatagtgtaaagaaaacccataaaccctttattcagtcacctattgttaatattttattacttttcctttatcattgtcacatagctccccccaattccgccccacctcattctctgtacatttctttttctgaattgaggatgattcatacccctcatagacattttcttttttttgttcttcaggttacatatctattcctttttttcaggttacagatttattcttttttttttttttttttttttgagatggagtttcgctcttgttgcccaggctggagtgcaatggcgtgatctgcaacctccacctcctgggttcaagctattcttctgcctcagcctcttgagtagctgagattacaggcgcctgccactatgctaggctaatttttgtatttttagtagagacagggtttcactatgttggtcaggctggtctcgaactcctgacctcaggtgatctgcctgcctcggcctcccaaagtgctgggattacaggcctgagccaccaagcccatcctctttttaaaaattttattatattttaagtactgtgatatatgtgcagtaagtgcaggtttgttgatatataggtaaacatgtgccatggtggtttgctgcacctattaacctatcacctaggtattaagccccgagtgtttcagctagttgtcttgattaaaataatttacattcccactaacagtgtaaaagcattcctacttctccacagccttgttgtttcttgaattttttataattgccattctgactggtgtgagatgatatcccattgtggttttgatttgcatttctctaatgaaaagtgatgttgggctttttttcatatatttgttggccacataaatgtcttcttttgggaagtgtctattcatatcctttacctagtttttaatggggttgtttttttcttgtaaatttgtttaagtgtcttgcagattctggatattagacctttgtcaggtggatagatcgcaaaatttttctcccattctgtaggttgtctgttcactttgattgtagtttcttttgctatgcagaagctctttagtttaattagatcccatttgtcaatttttgcttttcttccaattacttttgatgtttttgtcatgaaatcttttcctatgcctatgtcctgaatggtattacctagattttcttctggggtttttatagttttgggttttacatttaagttttaaatccatcttgagttaatttttgtacaaggtgtaaggaaggggtccagtttcaattttctgcatatgactagccagtttttccagcactatttattaagtaaggaatcctttccccattgcttgttcttgtcagatttgtcgaagatcagatggttgtagatgtgcggtcttttttctgagtttctgttccattggtctatgtgtctgttttcgtaccagtaccatgctgatttggttactgtagccttgtagtatagtttgaagtcaggtagtgagatgcatccagctttgtcctttttgcttaggattgtcttggctatacggggtcttctttgtatggtgtgggcatttatctgcccagtgccctacaaagaaattccatatgaaatttataatagttttttccaattctgtgaagaatgtcaatggtagtttgatgggaatagcattgaatctataaattacttctggcagtatggccattttcatgatattgatttttcctattaggatggaatgtttttccatttgtatgtgccctgtcttatttccttgagcagtggtttgtagttctccttgaaaaggtccttcacatcccttgctaactgtattcctatgtattttactctctcagtgattgtgaatgggagttcatttatgatttggctctcttgtctattgttggtggaaaggaatgcttgtggttttcacacattgattttgtatcctgagactttgctgaggttgcttatcagtttaaggagtttctgggctgagatgatggggttttctaaatataaaattgtgtcatctgcaaacagagacaatttgacttcctctcttcctatttgaataccctttatttctttctcttttcatggccatttttaatttttcactgtgtatttcctaagtatagggatatgctcttatatgactacagtacagttatcaacatcataactttatattggtacaattttattatgttctagttttatcagttgacccaaagattttttaaatagtacttttccttctctattacaggatccagtctagagtcaggtattgcatttggctgtcatgtctctttacctcctttaacgtagaataccctttgtttctgtacaacattgacattaaaaaatacactcctcaatacccatatgtgttaacggaatgatcttcatttgggcttcatctaatgtttcttcctgattagatttaggttatgcatgcttggccagaatattgcataggtgatggcgtgtccctctcggggtgccacatctggtggcaggactcccatctacttctaatcggtggtgttaattttgaccatttggttaaggtgttgtctgatttctctactgtataattaatattttttcccttgcactctttaatctgtggagagacacattaagaccatgcacatattcttctccacatcaatttttctccctaattttttgcattcattcataatccttggctcatctaatctttataaacaatggctgcaagttgctgattttctatcccagtactctttccacatttattagccagcacatggtattctgccataaacaagagccctctcatctcccctttttatttattttttctatatatttattatcaatatggaaacataattttctttattccccaaatggtttttaatagattagttaattattgccgttttgaaattgccccgtatttggctggtgggagcaccgttaagctggcttctgtatctttgggcgttctcccatcaattatttgagcacttacttgatagcataccaagatgttccaggctcatcttacacctatttacccaagccctggaatcagccacttctctaaggagtcctggtttctttcagtggggaattatattagatagcaagctctaggtactaggtgtgctcattgttactaggtgtggcattttgaccctttcaatgtacagaactaggaaatacatgctatatacagagacatatatatacacacttgcatatgcatacatatgtgcttaaacatgtacacatatacatgcgcctgtacatatatctacgtatctttgaaattttgaattcgcaccaatactcacaattttcaagtcatccctgcatggctatttcttgtctttccccgtttcatattcgtatgtaccttctttctcattgacaaccctggctcctaaattaattcatttgctcaaccctctaatacatctaaaataatttcacaacttttcccacaccattacaaaaaagattatcaaaaatagttcagggtttgtttacaattcttgttaccaccctaccctactccgctgcaaactgagggtggatggccaattacttggatttttttcttcctttcttcctttatttctttttcttttttctctccctccattatttcctccctcctttccttcatctcttcctttctctctttttatttttttattctcttgttctttctctctctcctttcctccctccgtctcttcctcactcctttctttctgttcctcttaagagcaattgtagcattcctttgaaatacaattgaattcatgtggttcactttgctttcagttttagtcccctcctccttccacccttattgatttagctatttttattatgtagaggattaaagtcttgagaaagtcaaaactatatacaaaaaggaatattctagggtgtcagttccttcctcaccccctccactcctttgccgtcccaacataagaatatatatgaatgaaaacattcacattaaacaaagtgatatggttgcctataggggaagcatgagagaatgaagttaaaggggaacttgttgatcaatcaattgatcaaaatagggttttgccccagggatcactgatgattgtatacaatgaaccaggggacatgactaactgcactctcaagtacttaagtataatttcccctcaccccactcaaagccattgagacagatggcagaaattcacagtgtatgttctgctaaacactggtctcatgagctgagtgcagggaagaagttgtttctggtcaaataagtataggtaacattatatatgtgatcctcttcttggaagtctttctgtcaagaaactatgttttcctgacatggaattcttttttatttgtataaatttcaagggtaacagtgtagttttgtcgcatttacatgaatattttgtgtagtggtgaaatttgagattttagtgtaactatcaccccaataacacacattgtacccattaagtaatttctgatgcctcactcccttcccaccctcccacccttgcaagtctccaatgtgtgtgtggtgtgtgtgtgtgtgtgtatatatatatatatatatatatatatatattgttttttgagatggagtctcactctgttgcccaggttacagtgcagtggcacagtctggactcactgcaacctctgcctcccaggtacaagtgcttctcttacctcagcctccccagtagctagaattacaggcacctaccaccatgcctggctgattttttatttttagtagagatgcgcttttgccatgttggccaggctggtattgaactgctgacctcaggtgatccgcctgcctcagcctcccaaagtggtgggattacaggcatgtgcctctgtgcctggccaccaatgtatattattccattcaacgtccaagtgtagaaattatttagctcccccttagaagtgagaacatgcagtattttactgtttctgagttgtttcacttaagcctccagttccatccatgttgctgaaaaagacataatttcattcttattgtgagtgaatagtatttcattgtgcctgtatatatatataccatattttctttatctaatcatccattgatggaacttaggttgatttcatatctttgctattataaatagtactgtgataaacatttgagttcagatatctttttgatgtaatgatttcttttcctttgggcagaaatccagtggcaggattgctggaccaaatggttgttctatttttagttatttgaggaatctccatgctgtttttcatggagattatactaatttacattcccactaatgcataagcattctcctttctccacatccttgccaacatgtatcatttttgaatttttaaataatagttattctgactggtgtaagatgatatctcatcgtggttttaattagcattttcctgatgattagtcatattaagcattttttttcatatgcttgttggccatttgtatatcttcttttggaaaatgtctgttcatgttctttgcctactttttaatggggttatttggggatttttttttaagttgtttgacttccttgtacattctggatattagtcccctgtcagatgcattgtttgcaaacattttctcccattctacaagttgtctttcactctgtcgatcatttattttgctgtgcagaagatttttagtttaatgaagtctcatttgtccatttttgtttttgttgcttgtgcttttgaggtcatagtcattcattctttgcctataacaatgttcatagagtttttcctagatttcttttagtatttttatagtttcaggccttacgtttatgtacttaatccatctagagctgatttttgtatgtagtgaaagatagggacccagttttattcttctgcatatggcaattcagtttccccagcacaagtattgaaaagggtgtcctttatccagtgtatgttcttgtcaactttatcaaagatcagataactatagatatgtggcattatttctgcacattttattctgtcctattgatctgtatgtctatatttattacattaccatgctgttttgtttgccataggcttgttgtgcaatttcaggtgaattaatgtgatgcttctagctttgtcctttttacttaggattgcttttgttattcaggctatttttttggttccataataattttaggattctttttttctaattctgtgaaaaatcaccctggtatttaaatagggatcacatcgaatctgtagaatgctttgagtagcatggttattttaataatattgattctcctaattcatgagcatgggatgtttttccatttgtttttgcatcatctataatttctttcatcagtgttttataattttccttgcagagatctttcaccgccttggttaaacatattactagatattttattttttggtagctattataaatatgattgacttcttgatccagtcttcagattgattattattgttgtacagaaatgctactgatttttgtatattgattttgtatcctaaaacctcacttaattaacttagcaaatctcagagttttctggaaaagtccttagaatttctaggtacaagatcatattgtcagtgaacagagataatttgacttgctttttttcaattttgatgtcttttatttctttctcttgcctgttttctctggctaggacacccagtactgtgttaaattggagtggtaaaagtgggtattcttgtctgttcagctttttaggggcatttctttcaacttttccccattcagtatgatgttggctatgggtttgtcatatatggctgttattatgttgaggtatgtttcttcaatgcctatgttgttgaagaattttatcatgaagcagttcttaattttatcagaagctttttctgcagttattgaaatggtcatatggttgttgtccttaattctgctcatataatgaatcacatatatcagtttgcatatgttgaaccatccttgcatccttggactaaaactcacttgatgctggtgcattatcttcttgatgtgctgttggattcagtttgctagtattttgttgaagatttctgcatctatgtttatcacggatattggtctctagttgtgtgtgtatgtgtgtgtgtgtcattgtctggctttgatatcagggtaatactggcttggtagagttagttagggaggatttcctgctccttgattttttggaacagttttgggaggattggcattattactatctacctctttctttaggcctagtaatctttgttttataagtctgggtgcgctggtgttctttgtacatttggtagaatttggctatgaattcatctgttcctgggatttttttcgttgtcattgggagatttttttttacattactgattcaatctaattactcattattggtccattcaggatttctatttctttctgctttaatcttgggaggttgtatgtttccaggaatttattaatttcctgtaggttacctagtttgtgagcatatagttcttcatcgtagtttctgatgatcttttgtatttctgtggtgtcacttgtaatgtctccttattcatttctgactttgtttatgtggatctttttttgttagtctagcttgtggcttgtcaattttatttatcttttcaaataattgtttttttattttgttgatctttttatctttttttggtctcaatttcatttagttctgttctcatctttgttatttctttcttctgccagctttgagtttactttgttctgtttttccagttccttgaggtgcaacatttgattgttaatttgtgattatttttatttgatgtaggcatttaacattataaacttccctcttatcactgcttttgctgtatcccagaggttttggtatattgtatttccattctcacttatttcaaaacatgttttaatttctgtcttaatttcattgttcacccaaacattgttcaggagtggtttaattttcacattctacagggttccacatggtattaatttgtagtttaattctgctgtagtctgagaagatacctgatataattttgatttaaaaaatttattaagacttgacctgtggcctaacatatggtctatcttggaaaatgttccatgtgctgacaaaaaaaatgtatgtcttgcagtggttggggagagtgttctgtattaactgttaggtttatttggtctaaagcctgattttagtctagcgtttctttcttgattttctgtctaaatgatctgtctaatactgtgagtgggatgttgaatccctcactattagtattactgtctatatctttctttaggtctagtaatctttgttttataagtctgggtcctctggtgttgggtgcatatatatttaggattgttatatattcttgttgaattgatccctttatcatgaccttctttatcttttttacattgttaatttaatgtttattttgtcagatatgaatacagctactcctgctcactttaggactttgggttttcacttatgtggaatatctttttccactcctttgccttcagtctataaatatatttagcaataaggtgagtttcttgaaagcagactatagttcattcatttaaaaaaaatttattcaggcaatccatatcttttaagtgaaggatttaatccatttactttcaaggttaatattgatatgtgaggttttgtttctgtcgtaatgttaattgttatctagttgttctatagattcttttttgttgttgttgtttttttttctgtttatctttgtggttaagtggagtgctgttgtgttgccacttgatttctttctctttctcttttgtgtaattatttaataagacttttaggctgggcacagtggctcatgcctataatcccaccactttgggaggccaaggtgggtggatcacctaaggtcaggagtttgagaccagcctggccaatgtggtgaaaccctatctctactaaaaatacacacacacacacacacacacacacacacacacaaattagccgggtgtggtggcaggtgcctgtaatcccagcttctctggaggctgaggcaggagaatcacttgaacccgggaggcagaggttgcagtgagctgaggttgcaccattgcactctagcttgggcaacaagagtgaaactctgtctcaaaaaacaacaaaaaaagtcttgtgaattttatactttcctggcttttatgatggcaaatattgaccttttgtttccatgttttgtactccattgagcattttttgtaagactggtctagtggtgacgaatttcctcagcatttgcttctttgggaaatatgttatttcttcctcatttatgaagcttcttctggcaggacataaaattcatggttggaaatttttgttattctttgagtactttgaaaataggatcccaatctcttctggattgaaaggttgctgtttttttttttttttttttttttttttttgagacggagtgtcactctgtcactcaggctgaatgaagtggcgtgatcttggctcactgcagcctccgcctcctgggttcaagcaattctcctgcctcagcctcccaagtagctgggattacaattgcctaccaccatgcctggctatatatatatttttgtatttttagtagagacagagtttcaccacattggccaggttggttttgaactcctgacttcaacggatccacctgccttggcctcccaaagtgctaggattacaggtgtgagccaccgtgcctggatgtttgaaaggtttttgctgagaagtccactgttagtcttgtggggcttcctttatagctgactagaaaattttctcttggtgaatttaggattttttccttcacatggactttagatagtccgatgacttttctggtgaagaacatcttgtaatgtatttttctggtgttctttgagcctttcatactagaaagtctaaatctcttgatagactagggatatttttggctattgtattttaaaataggttttctaaactttgaactttttcttctcccttaggaataccagtgattcataagtttggtcatttcatatggtcccatacttcttgaaggctttattcattctttttaaaattccatttatttattcttgtctgattggattaattcaaaagatgtgtttcaggttctaatattctctcttaggcttggtctagtctactattgaagctttcaactgtattttgtagttccttcagtaattttttttatttccagaagttttgctttttaaaaaaaggtatctatctccttggtaaattcctcattcatatcgtgaattgattttctgattcctttgtattggtttttagatttctcttgtatctcatcaagcgtatttaaagtgaatattttgaattaattctctggcattttggaagtttccttttattaggatccattgctagagaatggctatgttcctttgggagtgtcataacacctagggttttcatactttcggaattattatgctgatttcttcacatctggagaaacagtctcttcttatttttgaatttaactttcattggggcaggacttttttttctggaggatatgattatgatgtattttgagtagggctgttgactttgcttatgggtgcatttggtagcgaagactgtatcatttccttggttataaatagccttagtatggtggctttcacaaatgccagttgtaggagcagtgtactgggtgggtgagtggattcatggcatcctgggtagctggagtggcataggcaatggtggtagtagaggtcctaagaggcttgtctcattcctgagcactgtgcagttgtgtcagcagatgttgtaatgggctgtgtgggttgacctctaggccagtaggtggtgcttgccagtaaaagccagctgtggtggtaacagtaggtttgtgcttgatcttcgtaaactgagagaagtagtctgttgtcccggttggtggattaggccctggagcactcaaggcctaagtcctgccacctctgtctaggagtgggtggcaaagctaggcagagccaaccagaaaagacttgaggtccctcaaggtaagcaccagccctgactggggtggcaaaggagtcctcagaccaaatatttgagtgacgagtgatcactgctgcactgaggtctctgtactggcagtgagggacagtctcagtgcctctttcttggcagtcaggaatgaggtcttctttcctctcacacccctgtcccagtgttcagaatagtcagttaggttagacactgcagtttgcttttaggctgcaatataacccaggaccacaggagatgccactccagcgactcaacactaaatctctgtggcagctggcagtgcgtgcagtgtggagtttccacccacagccccaaacactcagctttcaggctctgttactctctagggcagcaatgctgcatttctatgcaggaggagggaaagacaccgccctttgtgcaatgctgggctgaggccatgctgccagtggggtcacagttgtccctcagagtcccagatagaccacactgctcatccacatcagcctccttgagcagcagcagtggctgttcctgcagaagtgtgcgaagcaggaggtggggtcttattctccactcatgaggcagagtgagcagagactgcttggccagtggtgggggacttgactcttcacctgcaaagcccagcatagtttgcatgactgttgaaggcagggtcactttttactgtcccaaacagggagctctcaggctctcctgctctttgtggcggcagcactagaggaccgcctagtgggctgcctagtggagtcagggggcctttcctttccttttagtccaggctaagagactattccaccagtggggttgcggtcatcactcacagcctgagagaggcagcagtctggttagcttgtgccaacttcctgtggctgtagcagtggccgtgcctggagtgtttgtgtggaggagaacagaggtctccttctctaggtatgggctatagcacagaggctgctcagctggtaggagggaatttcactctctgaagaactgagcacagagtttgtgcctctgctggaagtggacacactttcacagccccatgcagggagctcttgggctctagaaagtcctttggttttctttatcctgggggctgccattttggtgtgctgtactcgtctttccctccacagaagtagcactccctgagggctacagagctggaaatcctgcagctcttttaggtccagctagcagtgttgctgcagccctcctactgggcactggggaatgtcagagggagctccgggatgtgaagataccagagttgaggttcctagggcaggatgcagtccctgagaactgtgctgtcagagtggcatcctgctgcagccactgagtctgggtgtagggtgagtgacccagtatgagtttacagtctggtgcaatgctctcatatattctccaaattaccacccatactagtgcagtcatgagaacagaggagctctcccatagttccaatcccggaagtctgcagtagggatgagggctaccaaaactcttgcacttacccttacctccaatactgagtcgctccaggcttctagctgatcatgactaagttggcctttctcttccttctttttctgtgcttcaggtttttcctgtgagccctccactgggttctagtgttctctctttgatattctatttgaggtataattattcattatttttattctttctagggagaactgatgtccagcacgtatagtcagttatcttaaaccccctgacatggaattttttgaatgaatatttactattaacatcattcagaactagtcttcagggggacaaattttggaaattttgagtccattcattgactcaaccatcatttattgagcacttactctgttctgcatgctgtttgtggtagtgtgcatggacagccaatgacagaaatatgaagtacttgtccttgtggagcactgaggttgggaaaaaggcgatgagataggcagaaatacaacagttggatacatgatgtccattactgtatccattctggaaagatgtgtagagcctgatgatcacctttcttccttgggaagactgcaaaatgctgacccaaaaggaaagaaaatgaaggaataaatgcttcaaccaacctggcggctaagcatcaggttaagagggaacataatgagggacttcaaccttctacatcatctgtatacatttgagcaagagccaaaaattagggggtataaaattaaaaagtaagggaaaaattctcgagtttttgatcacatccccatgttgataaaatatttatgagttctccttcaattaattagaataaactatgtaacactgcaagaaacacattgaaaattgaataaagtaagttcacttccaatttcttttgaagaaagaagctaattatatttagttctgtaattataactttaattaaaatataatgcaaaatattccataaagtgaaaacagtgctgagtaataaaatggagcttttaagacaatttgttctttagatgaaaatttataattaaaataaagcctttagtggaccctttcctccaaatttcatccttttggtatgaattaaatttaacaatcttcttataaagactaattaatgtttatttaccgttttaaacctatttcctcctgtttgttgcgtgctaaaatctccttttcatctgttatagctatcttccttttcgagtttgtttaaagagatactcctatttctcctttgcatatcataatttatagcacattccttttgagttagaacatcgcttgaaactttcagtgacttaaaacttgaaagctcagatgctcttagaagtagttcgcatatcagtccccttcacctggctggcacggagatgatttgattgctccaggcaaacatcccggtggaaggaaatttagatcctctaaaatgaaattaggaaggtgataaaatgaccttctggtgatgtttttaataatcatttgctctcaaacacttctcagaggaatagttgactaatagtttgcccagatgttagacttaaattccaaagtctactagaatgtgggaccatttgctgtgatgaaagtcatatccatttctaaaggccttttaaactgctctttaattttaaagctactctgcttttacccaaatcacagaggtttatggaaggaagatgcctagcttgaaagctcagagtttttctactcaacatctctttatactttagcattcaaggaaagagtcactggcttatgactaagaaatatttattgaatgcatactgtatagaagatactatactttctgcgcaaaaatatctccctgagtagttgttaaaaatcagatttctacaccaccactgcctccctctcacatattcagattcagttcatcttgtgtgggtcccaggtgatttttattcaattagtttgagagacgttgtactactgggtgtctacaagttccggagttgagtaatattaatacaaagaacttacaattctagtgcctggtgttgttaattcagtgagggaacatacttatttacaactccttttgctttctattggagcggaacttttcctgctctttccagagtggagaagatggctggagtaagtgaggaaaggaaattgtctgctctttggatgtggagaatgaaagtcctgttgcctatgatttgggcctcagtaaatgtcatggtgaggtacaaagtaatcaagaaaggcattgattgggggtggctaggatgctaggaaacgatggacccagaatcagtttcttgcttgatgctttactttagggccataaccttgggtgcctattcctgaaatacctaaccactcagattttcaaacctcctgagttttgcagaaaggattggtggcttttgaagggactttatgtgcttcattttgatctattttactgtgtctagcttagggtctgcacatactggatgctctaatatttactgcacatttaattgtcatggataaaaatatttgaaaaagtaaaatttgctcattctaataagttaaaccatggcagaaacataaaaaaactcatcatcttttgtactgcccacatccttaaggtggcgaacgtgaacaggttggtatgaatattttcatatcttttgctgtaggtaggttttaatatattttaaaccaaatgatattatacgaaacccaatcatctgcatcttttttttcttttaggttttgtaaaagcatgtgcttccctgcaggaactgtttactgctagagagcacagaaacctaggacagggtgtgtcacgggaggctagatctgtggcccttacaagtctagaccccaagcaggaagattacaactcagtgattctcatgggggcatatttggggggtattttgccaccccactctccagggaacatttgatagtgccagaggcactttgctgtcacacccgtggggggtgctcctggtattttgtgggtacagcccagggattctgctcaccattctaccatgtacaaggcagccactgcccctacccccacccctgccaactgcccacacagcaaagaatgaactagcccaaaacgttaatggtgccagattgagaaatattagaatagagaacaatgaggactctgtccctgaaaaaagagggatttattttcactcttgtgggaaattctaccaggaaaggatacggagctaaatatctcccaacagtacagagcttttcagtttctaatgtactttcttgtataatccctatttggtgctcataaattgtgtgactgagggcaagtatctctataagcctctgtttcctcatcaactaaatgggcctaatgatatctattatttacagggcaattcaataagaagatgcactatgcccagcccatgggcattattcaatatgcataagttgttaccattatttatgattcgggtttcatcagatacacagaagccactcaatgtgttccaagtataaagtcttttaatttaggcaaatagagacttaggcaattttggggaggatgcagtagcaaaggtcaatggtcagaaaagttatttccaatcatctcagtcagcagccttgaactcactgggtctagacacccgttgaaagctgctgtaactctcaagagctccaggatgctgcaggaatccctactgagctgttcagcatgccttgtaggggaggaagtctccagcagacacctcccaccactgcaggtgtccacagcactgaagcgggggatgcacacaggtgcttgcagaagccactgccaacctttcctgtgctgcgatgcctctttatgataatggcttaattctcctttctgctttccaaatcttatacaagtacttctctctggcagaatccaacctggagatgttccatgaaggaaattctggaaattatggttctgacttctttgcaatgtagaggacaccacggaaggggatgacaaggactttgaggtgacaatagacagtttggcatatttactgcaatcgctcttatttctgcagttctctgaaataggcattatcttcactttttaggtgagaaaatggtcactcagagaggtgattatattcttctgaagtataatttgtgacagacctggattctgaatttaatattttctccactacacaatcattctctagatgtcgtacaaaaaattagccatgactctggagtcattaaaagaaataaaggctttatttttccaaacatttttcttccataagtctaaatttctttattattcatttgggttaaaatattaaattcctcttttaaagtcacagtaaaataatagagaggggtggccataaaaacattattgatgattgacatcttaatccaaatatctttttcatcaaattagaatattatgtcaaaggaatcctattgtccttctggctggtttccctataaagcaatgcaatggaaagagagtggatttagagtttgacttgggttttgtgatttgctctccaagtgactttgggcaagacagtagctttgctgagctctggtattctcataaatagaagggagatgacaccattgccctcaaaatttcaatatgaagatttaataagataatatcaagagagcatggagaagcaccttatttctttacacacttgtactaaaaaatatttgaaatgcaccactgtgttaggtgctatgctaagcactaggaagatagatgaggtcttagtccctatggggcatatagcctagtgtcgttgggagggagacaatatgaataaataaataaaacactaaagaaggtagcaagtatcctcacaactgcaatacagaaataaacatggtgataggctatagagtgggggcgtggaagggtgttttgggtgggttgatccaccctgaggtggtagatatttgatctgagacctgaagtattacactaactctttctacgaatatttatttaaagacctattatgtgccaggcactattctaggcactggagataaagcagggaacaagacagtgtgtgcttgtaactttagtgaggagatacagataaacaagtgtataagtaaatatagggggtgatctattttatggaggaaagtgaagcagggcatatgccactgctgggaagacatttgggctgacattgaagggagtcatagataagccatgaaactatctgggggaaaagcactctaggcagttggaaaagcaaatataaaggccctgaggcagcagcatgcctgtttgagtaaagctaggatgcccatatgagtggagagaagggaatgagggagagggtactagaagagaagctcagagaggtaaaagggtctaggctatgtagacctttgtggtttatggtgaaaacattggctttttgtttgagtaagatggatgacaatgcctggtggtaaaaaatagactgtagggagcaatgtggggtcaggaatgtacattaggatgctagagcaattatccatgtgagacaggatggtgccttggaccagaatggtagtagcggtggtggtggtaactatttggattctaggtatgttttattttattttttattttttttttgagacagaatcccactctgtcactcagttccatggcatgatcttagctcaatgcaattctcatgcttcagcctcctgagtatctgagattacagatgcgtgctaccacttctggcgaatttttgtatttttttagtagagacggttttcaccatgttggccaggctggtctcaagctcctgacctcaggtggtccgcctgcctcagcatcccaaagtgctgagattacaggcatgaaccaccgtgcctggcctacattctagatatattttacaggcaatgtcaacagggaggatataatgaaagattagattttgggcgaaaaagaagaaagagtcaaggatgactccaagatttggagccagagttgttcagaaaaggtagagcagtcgtttactgagatggggaagcaggttgcagggagggaatcagaaattctattatggtcttgttaagtttaaggtgccgattaaacatccacaggacaagtgggaataagaagttttgggaaaagtcaatggtggagatctaagtttgggggttgaaagcatatatatggtatctaaacccatgaaactaaatgcaaccagcaactgtagatagagtagttgagaggcccgaggtctaatctctggggtgtggcaacatttacgggtggacaagacaaaagtagctaacagaatggatactttaggaaagaaagagaaagccaaggaaggaagtgcttcaagaaggaaggtaggtcaatttgttcaaatgctgtgaataactcaagtaaaatgaagactgaaatcttttggatttagcaatgtgaggtcaatggtgactttggcctgagcagttttgatgtagtaatgtagatgtaaacttaattggagaaggattaagagagattataaaaaaataaattagactctttgaggattttgttgtaaagaagaacaaagaaatgggcaattaaggggggtgtgggaaagaggcatgtggtcaaaagaaggtagaataaaaatggtagactcgccagaacttcaaagtacaatgatatatcagacttatctagagagagtttgttcaaatgagattgttaggttctacccaaacttcaagagcatatcacagtcacccgtgtgtgtggggaggtgttgcatgttaaaaccagacagctggtcccccttctagagtttctaattcagtaggtcatgggtaggactcaagaatatgcatttccatcatgatctcaggtgatgcagatgctactggtacagggaacacactttgagtatcactgctcatggacacaaattcctttgctgacccttctatgcaaagtaacatcctatcctcccatccttttcttctactctctcactatgtgaatctgccttattatttttcattatttaaatccccattggcatagtttctctaggaaaggagacctatctctcttgtttaccattgttccccatgtgtagcatcatagttagcatacaatggaaacaaaattttaaacaatgaattaaataaagaaatgagaagttccaacaataataagcattgctttatacaatctttgagatgcctaatgtttctttgggactctttataaagataaacaaaaagccatgttttgctaaatggcaaactaagagttaaatttcaatctctgagacacccagagggatctgagctggttatttacatttcaaaattcattgtaaccagcctagagatccctaatgtgactgttatgtggtatttcaaatatgatcacataactttcaaagaaaattctgcttggaaagccatgagttgttttgtcattaattatttacttctaggttcacaactgtcaccgtttcagaaacctccctagttgaagaaataacattaggggcatgctttggtcttcaatgcactaattagcctataagccaactcatttgtagctggctcagtctaaatcatccaggttttacatgggggatatttaaggcccatttagttggaaaaatttacctgccaatccaagcctcttaaaaatacgacacaaaacaaaacagggtcgccaggtttctttaacagtttttttaagagtgttaagtgaaaacgtctctgtttgatagtcatcatttgtcaatgaccgtttcttcactcagacaacatgaataaaatatgttactttttgtcattagcaactcattcagggaaaagagaaaaattggacatttaagaacatcttactttctgtcatttcggagtaaatgacgctcttaaatgatggctagtcaaacctacagaatctattagtaacttgaaaataagtgtgaagggatgctaaaacccaaaggaatcttaaacttgcatttatcaagcttgtcacatcattgctcctggtaataaaagcatttttgttttatgttgtaatgtctacagagaataatattttttttggccagtgtaaaaagtgatattgcaacattcatcatatattttgatataaaatagtctaaaaaggttgaaaactgacattcattattttagagctaatttaaaagccttgtgcatttacagaagttttcttggttgctttttataaagttccagtgttcaatagtcattcaattttcagaagcattttcttttttttttttttttctttttttcttttttttaattattattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttcatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggcttccccaatctagcaaggcaggccaatgttcagattcaggaaatacagagaacgccacaaagatactcctcgagaagagcaactccaagacacataattgtcagattcaccaaagttgaaatgaaggaaaaaatattaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatataagcagccagaagcattttcttacatggatttcatggattttgttgggttctcagaataaatgctcaggttttaatgatggtggtagtacctgaccaattgattggtgtatttattttcttataatcactcagctgctggtcctgttgcattgcaatgaccaaagaaacaaagacttgtcatttttcaagttctataagatttaatcatagcccaaactttcactcctttctttttttttcccctcaagatctccaaagcaccgatctaatgaaagaaaacttaatctaggaagtgaaagagaaaccaagactggaagacgcagttgaaatggattgccacgtttatacatacattgatttttacatgactgcattcagaaacaaaataccatcctctgtgattaatttataaagcttccctctcagttaaattaaaaacaaagtgaatccatagcagcagatccccttttagttagagatctaacctctctcaagaagcaaacatggatttatacctccctcatttgatggtcagcttaggacaattgctgaattctctgacactgttgggaatccgcacagtaaaatacatgtgatttctactgaaaattcagatataagtcaaactgctacattggagaggtaagagattctgattctgccacttaatcatcttctgaatattaggccaggaaagaggaagtataacatgacttaaatttttgagggtactgggaatctatgcacctctctccataattgtgaccttgacttagctagtgcggtcgtgcagcatgtcacacatattggctggtaaaatataagatgattaaataaaatacatgaaacaatgtatttttttttttctgagacggaggctggctctgtcacccaggctggagtgcagtggcgccatctcggctgactgcaagctccacctcccagtttcacgccattctcttgcttcagcctcccaaagtagctgggactacaggcgcccgcccccatgccaggctaattttgtttttgtatttttagtagagactgggtttcaccgtgttagccaggatggtctcgatctcctgacctcgtgatccgcctgcctcggcctcctaaagtgctgggattacaggcatgagccacggcacccggccgagacaatgtactttatttagtggctacagattcatttttacatgtattaaaatattgctagaacctcaactctttggtttcatggatacaattctcaggacattgtgaaaataaaggccttaatttgaaacaaactttaagacaattttagagaaaatactacaatggggtatgcaagatatgcatgaagaaagtgaaggactgaagtatgggaactaccactagggtagagttatttttcttccttttaagatgttggtgagccttgtctgtcttttctgaagtatttggagaaaagggagggaggacagagtgggaggaagagagaaaatggacctgaccagttagagaactatagttattcaaagtttatcaagtagaaaaagagaaacattcaaaaacatattttgaaatatattttgaaaaagcaaatacaaacatttagagaatagtgtcatgaaccccaatatagctatcacccaaattcaacaatggattttgttgggttctcagatcaagtcatgaccaatcttgtttcagttgcatcccatccatttcctttcatcctcccagattattttgaagcaaattccaggtatcatatcttgtctatatgtatctcagcagtcatcttagaaagataagaactttttttaaaaacagagatttctagttgcttttctggcaggtaagaaacatagaagttgccactctgtcctaacaagtacaaataaatgaggtcatcagacccatcaaagaaatgaggtcacaggaaagactactgtccccaaaattggagagattgggagctacaatccaagatgagatttgggtggggatacaaccaaaccatatcaccatgctaacatcagtcaaaagaagtggaagtagctatactaatttcagacacagcagacctcagagccaggaaaattatcagaaataaagaggggatattacttaatgataaaagtgtcaatgctccaagaagacataacagtctttaagatgtgtatgcctaatgacagtgtcaaaatagttgaaacagaaactgagagaattgcaaggagaaacaggagaatccacccttatagttggagactccaacactcctctattagaagaggacagatccaaaaggtggaggacatggttgaactcaagagcaccatcagtcaacttgtattgcacatattagaaaagaagaatctcaaatcaataatttaagccctcaccttaggaagctagaaaaggaagagcaaattaaatccaaagtaagcggaagaaaagaaataataaaagctagaatgcacatcaatacaattgagaaacaaaaagtcaacaaagaaaataaatgaaatgaaaaactggttctttgaaaagatcaataaaacctctagctgggctaagagagagagatgacataaattactagtaccatacattaaagaggggatattactacagaacccgttgatgttaaaatgataacaaaaggttattatgaacagttctatgctcacaacttgataatctagatgaaatggacacaatttcttgaggaatacaacgtgtcaaatgttacacaacaagaaagaggcaatcataagccaatatctattaaagacattgaatcaataactaataacctttaacctttaaaaataaaagcaccagacccagaggggttcactgctaaattataccaaacatttaaggaaaagaaatcataccaattctctacaatctcttccagaagattaaaacagtgaatagtttctaactcagtctaagaggccaacactgcttcagtacaaaaattagacaaagatattacatggaaaaaccataaagagtaatacctcacacatacataggtacaaaaatccttaacaaaatattagtaagttcaatccaacaatgtataaaaataattatgcaccatgatcaagtgtggttatcaacaaactgattttaaagtttctatggagaagcaaaatacccagaatagccaacccaatatcaaaagagaagaacaaaactggaggcagtaaaaagtgttgtggttgacagggcttagatgagagggacagatgaatagacagagagcatagaggatgtttagggcagttaaattattctgcatgatactttaatgtgaatacatgtcactatacatttgtccaaacccacagaatgtccaacactaagtgatccctaatgtaaactgtggactttgggtgaaaatggtgtgtcagtgtaggtttattggttgcattaaatatacactctagtgtatgatgtagagagtagggtatgttgtgtgtgtggggtgggcgggaagcaggaggtagataggaactcactgcactttctgcactttttgctgtgaacctaaaactgctcaaaaaataaaatgtattaacaataaaaaagccaaaatagcagtgtcattgttacaacatcaaatatatgagtagttcccaaatgccataaatattcgctcaatgttcaaatttccctgagtgcctcatgaattattttagatttttacagtttgcttatattaagtcctgaaaaaggtccatactttgctattagttgatttgtattgagttgtattataccaatgtgtccttggtgcttatttttactttctattttagtgaagataaaaggcaatttttaatctatcagaaccatttacattgctacctacatttcttaatttattaagcatcaagcactcgaatgtcctcaagattctgccaggtaacatacagactggaaaagtgagctagatgaagactgtgaccaacaggagggctcaggttctttctgtaggtggcagcactttctcagctctggccactactaccctgcagaaatttgtatagtaggggagggtgtatgactagattttccagagaagctggcaatctcaattttcatatcatgtctcctgacttttaaatgttgtcaaataatgcaaaattttgaaacaccaatatgcaggtcaaacaaaacacatctgcaaaagtttccagcttatgacctaccagcacattatttttgctacagataattaaatggactgctgtcatttctattgccttctatcttttcattctggaagttgagggggaacatactctcctccttatgcccttgtctccctttcaatttcagactgtgactcgtattttaggaagagctgatctggcccaaatgcttccctttacttatgggttactggggctcagagaagacaagtatgttaaaaaaaaatcaacgggctttgttgattatctaaatctttaatctagttctgatgccagtgcagggtactgtgcaccatagccggttattagtaaagcaataatgcagcaccatcatgccactaaacacgtttctgttctaggagcataaactttcccaggcgttggcatcccatgacttgttcagttacttggaagcagagaaggaagaagggagctaacagtcaccaagaaactggaaagctctggaccctgtcctagatgcattgtgttatcttaataattaaccatcacacaaaatcaccaagatgtggatattattatctttttgaatacatgaaaaaaagtgaggctcaaagatttaagccactttttctaggccacacagatattaagtaacagaccctggtttgtgtgactctcaatcctgggttctttccataactccattaacttcatactgcctgtcatttccaagctcccaatgacacccaatgtcattttcttaatttctgcaacactgtaacctaagacagatggcttagggagtagtgctgctttcctagaggacagccaaggaccatagcagcatgttgtcttggaggtttctctcccttcatcgctactattctccttcctccacttcaagtcacctttctggaactcatttaccaatcaggaccaattcacttgctaggttagtgtcccagcaggaaacagataaaatattcaaatgagataattgagttaagtttaatgaaggagacattagataggtatgggcagtgttaagagagactcacaaacagtggtgtaggactccatggctagtgacatcagggaatatttgctgccaccaaacagcagctgtggtcttggaaaaaggcagccactgcagcctgacagcctggccaggaagtagctagggatcaaaactgtgatgtccctcccatatatgaaaggaagaaagaaggaaagaaggaaggaaggaaggaaggacagacagacatggagggagggagggaagaaggaaggaaggaaggaaggaaggaaggaaagaaggaagagacaaagtagaaaatggaaatggaggtgcaaacaaagaatactctgattatttccttcacttttctgcaagctgctgccacctaagcagacatgagccttgttctgaaggacacctctgctagaaaagatcagatacttccctctcattctgagcttcactgctgtgtccctggctggaatcccagccagcttgcatccagacacacctttggctctgcactggcatacgtgagactcgctaccatctgggtcaggcaaccaacatttttcaagctcatgctataggataccgagtggaaaagccaccttctttcccaagcacatctgcacggttaacatctgcacatttctgctctttctggaaacttgacctgtgtttttacttcactttcttgctttctctggccctgctcttttacttgaattcctaataatattttgctccccctctacccctctgcctccaggaccagagtgccagcaaatcaagttattttcattttatgaatatgcatatacaaaacccaagatattttctgagagaaacttcaaatttgatctgcaggaaatatgctgttatttctgccaatgaatagaagtatcgctgaattaaaccaaaagccagccggttctgtgctcttggaaagcgttttgccatttttcagggaagaactttttcagtgtgctgttgttgcttggacaaactattttttattttatcaaacatatggagaaagttggggttttgccctccttcaaaattcttagagaagacaatgcacaatcgatttcacatgatgtaaaccttaagtcccttgcttcagaaatctgtttctttcctaactacatcagaatcagcactttccttctcatgttaggtcctctttgtgcaatcagcaaaaatgtaacaatttgattttttttttggctcctcatagcacttttcccaattatacttgcttgacactatacaacagcataataaagggttggtttccccctatctgcaacacaaaacatggtacagacatgagtgattaaaaaagacagagcaagagcaaagagctcatatcttaacaatggtgtcattacagaattttaatgcttatgccagttgaactttctggcaagttagactaatgttagagtaacattaagttagtcattaaatactgagcatgctacttataaatgttgattggatcctattggttgatgatgttgggttattctttacacttgctaattttttgtctaattgttctatcagttgttgagagggatgttgaaatcgccaactataactgtgtacacttctgtttttcttttaactatgttgtatttggtggctttgttgtttgatgcatacacatttaggattgctatgtcttcttgtttgattgatctttttaatcattatatattgattttttaatcgtatatattttatcattatatactagatatagaactttttatcaataaatatatatttccttatcattatatattatatatgattatatgtcatcatgtattattattatatgttttatcactgtctatccatgtttctggtaattttctctgcagtctactctgttattaagatagccactttaattttgattttgttaatgttttgaggatatatctttttatactgtgtcatcattttatcatttgaaatgatgtatgaaagcccaggttccttttatgcccctttaaactcttacgtttataatatatagtcatgagccatatgacaatgttttgatcaaagatagacctcatatatgatggtcccataagattataatggagcttaaaattttctatcacctagtgagtttgtaactgtcataatgttgtagcacaatgcatttgttactcatgtttttgtagtgatgctggtataaacaaacctattgtgttgccagtcatataaagttatagcacataaaattatgtagtgcataataatgatagtggtaataaatatgtatagtgttttttaaggtctacagtagcatacagtaatggcctaggacttcacattcactcacaacccactcattaactcatgcagagcaatctccactccttcaagctccattcatggtaaatgccctatccagtgtaccattttttatccttcacaccatatttttattgtatcttttctatgtttagattttttttttttttttttgagacagagttttgctcgttgcccaggctggagtgcaaaatggcacagtcttggctcactacaacctcacctccctggttcaagtgattctcctgccttagcctctccagtagctgggattacaggcatgcgccaccatgcctggctaattttgtatttttagtagaggtggggtttcaccatgttggtcacaaatacttcccatagtgttacgattgtctaaagtattcagtcaagtaacatgctctgtaggtttgtagccaaggagcaacaggctatatattatataggctacatgtggaagaggctataccatttaggtttatgtaagtacactctcatgttcgcacaataatgaaattgcctaatgatgtattttttagaatgtatccatgtcatcaagtgacacatgaccgtaattttctaaagttttcctctatatactttagaactgtatcagaaagtattatactctttgcttcaatcatcaaacataatttagaaaacacaacaggagatgaaaatcctattgtaattacccatatttttgcttgccatgttcattcttccttcttgatattccaagtttccttcatttgttgttttcttttggtttagagcttattttagccattcttttagagtaggtctgctgtttccaaataatcttagtttaccttcatctgagaatgtcttgatttttcctgcattcctgagagatagtttcattgtatatattttttctttcagcacttgcaagtgttgtgccaattcctcctgacttcctgttccgatgagaactctgtcattctaatagttttcttttgtagataatgtatcatttttctcaagttgcttcaaagatttattattttttaaaaaaattttaagatgattgattataatgtgctctggcatagatttttaaatttatttttagtttatcctgcttagggtttgctcagtttcttgagtctttggaggtttgtctcttgctaactttggcaagttttcagctgttgtttctctgagtgcttatttattctttctctttcttcacctctccttccaatgaaatcaatgtcagattttttgtgatagtcccagaaggccctgagaatttgttcattttgggtttagtcctttttcactgttttattcagattggataatttttgttgttttatctttactgatttttcttctgtcccttccattctgatgttgagcccattcattgagctttttattttctgtattgtattttggaggtctaaaatttgcttttagttttaaaatatctttgatttgatttttaatttattgcctaagagctctatgttttcatttgtttcaagcatatttgtaattgtttgatgaagcgtttttatgatgggctgtcttaaaaatctttgttaggaaatcgtaatgtctttgtcatcttggtgttgaaatctatggattttctttttcttaattcaatttaagccctccttgggttttggatggtgaatcaataaatttttgaaattctgggcacttttgtttattttatgagactgtgaatcttgtttaaaccttctgctttagcttgctttttctgaaactactctgacaggggaaagagaagggatagccttgctacttccaggtggagataggcatcaaggttccacagtcagtctctgttgatacctgtgatagagacttctgattgttgatgagtgggagtgtaagtctggctcccacatgctgtccactgacattgcaatggggaatggcctcattactgctgagcaataatgaacatcttgactcttcctgaggccttctctgataccaccccagtggggaggtggaaagacacctcattattgcctggtggagatgaatgttcaggccctccacttggcattatatgacaccaccctgccagagatgttgtagtacctccttgtagtcttggaagggtaaaagtttaagctctccatttgacctttgatagtatggatgcggttggagccacattttgtttttttctgtggtatttggctataggggtgaagatggtgtttaaaattttctggcttgttaggctgtgctttcctggtcctttggctagagagagcagagttttagggggcttaactgttgagttcttcaccaccaagtctggtatatatgaagcaaaaagaacagccaaggaacttactactgtgttatttttcaggtctctaggttccaaacagtcagtttgtcttcatggagtaagtgttggttgggtaaggtgctttagctttggttctggatgggcacagtagtgtagtgttctcatgagatcttaggctgtaatcaatgtcagtggtgtctgttaattccttattggcttatgctgcagttgtctgtggagggtgtgatacaactatggtggatatagggactttcatgggtcagtcctcaggcctcaagaggagggagagtatgcaaacactgatggtggcagtgatagacctcaggcaggcctatgaacaatctcttcatagatatgtacaagaatttttctagatctgttctgtccaatgtggtaaccactagcacatggcaatattaagattaaaatcaaagtgaattaaaataaaatatgtccttattcacagtagccacatttcaagtgttcagtaaccatacatggcaaatggttaccacattagaaaatgaggttataaaatactttcttcatcatcaaatgtctattgggtagccctggcttagagtacatatttaggagcagagttactggtttgaagagtatgagcttcattacctttattagaaaatgataagatgttttccaaagtagttgtattgatttatacttccattagcagttgataagaattcttattgtttcacatttgtgttaagaaattttgtcatattgatgggtaggaaaatgaaaaggtaccattttctcattaactaaagaaagtggatatctttttatgtgtttattgaccattataaaagaggctgtttaaatctttcacccatttttccattgagatgtttattcttttcttattaattcataggggttttaaaagtatattacacactaatcttttgtctattaaatgtactacaaatgccttcttcactttgtagctgtcatttttctatggtgtttcttagtcagaatagaacagactaaactgggataacacatgaatctcaattcttagtgaaataatgaagtctgatgttagtagctgtgccttataaaacacatggccttcacagttgctgcagcaagggaaggagaactagagaattgcataggttatttttaagtgctatgtttggaagtggcttatgtcactactgtccaaatcacatctggccccaatctaatgcaagggaggttggaaagtgtagggaagtacatgagtatttcagaggattcacagtatctgccacatggtgccatttaaggaatgggcactctaattttaatgtaattgaacttaattctctttcattatgtttttttcttctatcttatttaaaaagtccttccctacttcaaagtcaatttcagaataaaatggaggattccttgaatggaacggtgaagccattttttctacattgcctctaaacttgctacccttttgctgttcaaacttaggtctttaattcatatgaaattgtcttgttttatttaggggttcaattgtattgttttagcaccatttatagaaaaactcatgtttcccactaatctgtgaatcaaacatgcatacatttctgaatatgtttctggattccagatactgttccaccgctctattcatctattcctgggctcataccaccatatcttaaatactaaatatttataaaaactcttgatgtctggtaaggcaagtatcttaccatatacttcctattatgagctgtcttggctattattagtctttgtcctgctatttgaatcacataatctttttgtcaaacttcaaagtaaagccaactggtattgaatacatagatcagtttgggaagaattgttatctttacaatattgagtcttcctatctatgaacaatgataaatctgtatatttatttagcacttatttaatacattttaataaagtttcaaaggtttgtgttgttaaagtcttgtatatgtttagttaaattgatttgttggtactatttaaaatgttattttaaaaaaacttacatatttatactgcttatcatatggaaattcagttggtttttcagtatattgtatggtcttttctttgtaatttttagattttttttcctgacttccactcaataacaaggtatagatacctaattttattttttactcctaggaggtgtagttttatttctagtttgtctgctgagggtgtaaattttttagccccaggtatacgtgtagaatctcgtattagatttactaccctgaaagatttttctcttgtcttcattcctcatgagaccatgaaaaatgaagcccaaagtcatttgggctcagaagatgccctcagggtaaaagtgagctttgatccttgtttatcatgttgggctcttgttcttccttaagtcctctggacaatccttatcttcttgccagtttatcaatgcattaaaatagatgtttatttttatttgtatttggttttagtatatatatacacacacacacatatacatacatatatacacacacacagatacaatttcagcttctggcagcatagtagactacataaactaattgattgatatatatatatatgtttgtgtgtatatatatgtatgtgtgtgtgtgtgtgtgtgtgtatgtatatatgcacacacatatatacacatatgcatatatacacacacatatacatacatatatatacacacacacagttttaaaccccttcaaaatcccatattcgtaataattccaaaaaaattctctataattatttttaaaggctgaatttaaatgacttgtttccattgaattacaaatctcagcagcgatattattgtaattcaactttctttactgattcatttttttccttctccatttttctttcttatttggctgttaagtcaataaaatactttaagacttacggtcaataaaattggcttatccttcttgttagatggattgacattttataacaatctacccaatctcctaacactgtggcctttatattgcacattctgtgacagtgagagttaatgctaaccttgctagatcttgcaaaatcaagttgtctctgatataaactttcctcccatttctaccaattaatcaacaagtggcttttgagtttctaccaaaaagctgttactgtgataatggcatacttgttctgctagccaaggggtgttaagccagattttcccaagggtgagaatctgactaaactgattttgtatgattaccctaatcctgccctttctttcacagattccctacaggaatttctcagggagaccaaagggtatagttaattacttttggaatcttttcctctgtggatggtaaaacaacacatagaacattgagataaaaatttaagcccataagcaagttgtgccaattgagttcaggaaaattcaaaattagcagttcacttggtgttttatcattataataaatatgaaaatacttaaagcaatgtcccaatttataaactccttctttattgatataaagaacattggcccacaaaatatcgtctgtgctatataatctccccgttaaagagctgtcctaaatatttttctataattacaaaaaatacaacaaatatctctcataaaattaatatttgcccaaattgctacaacacttctcttttgagtggttgataaagttaactgatatatttttctctcatcactgaaaaatattcatgtttctgcacaattaatccttgtttgctgttgagagaaattaaaatagagataaggaagtagaaaaaactcatttcaatactcagaaataattactcaacattttcaaaaatgttttattataaaataatttcatagttataggaatgttataagaataatacagagaactcccatattcccctcaatgattccatatgtatatattcaatattctacctgtatatctatttattatttttacttatgtatgtcatcatttttatgtatttattttattattttatatatatacatacatacgtatcatatatatttatatacacataaaggatttggaaaaatatgtatatacatacacacacacatatacatattttttcctaaatcatttgagtgacaattgcatctattataatccttcactctgaagtgcttcagggtgtatctcctaagaacaaagtcattctattacataaccacaactcgattatcaaatttgagaaattaagcattgatataatactctcatttaaaatacagctgatattcaaattttatcaattgtttcaacaatgttctttataataattttccatgatcctgagttccatcatcagtcatgtataaaatgtagccaccatgtcttgtagggtttttttaatcctcagcctttctttatctttcatgacattgacatttttgcggagaacagaccagttgatttctagaacgcctttcaattagtttgatatttcttaattttaaaaaggctttaaaaaggttatatgaactcactttcagctctgccttcctattctcttgagattctaatttattctgacttttggtccctatcattcttccaagagtgcttttatttaggtcactagtgaccttcatgtcgcaaaattcaatgctcaattctcagtctttcattcaacctcttagcagaatttgatagagtttatctcttctgcttacttgagagtaccatactgtatatgcattcctagttctaccacaccaattagttagaaaatcatggagattctatctactgtgaacttctatccactctctctcatctgttgctactattacttcctgatatggtttgtgtgtgtccccacccaaatctcatcttgaattgtaactcccacaattcccacgagtgggaggtgattggctggctcctctagtgagaggtgattgaattatgggggcaggtctctcctgagctgttttcatgacagtgaatgaacctcacaaggtctgatggttttagaaacgggaatttccctacacaagctctcttttgcctgctgacatctatgtgagctgtgacttgctcctacttaccttccaccatgattgtgaggcctccccagccatgtggaactgtaagtctgttaaaaccctttcttttgtaaattgcccagtcttgggtatgtctttatcagcagtgtaaaaaatggactaatacagtaaattggtaccagtagagtggggcattgctgaaaagatgcccgaaaatgtaaaagtgactttggaacttggtaacaggcagaggttggaacagtttggagggctcagaagaagacaggaaaatgtgggaaagttcggaacttcctagagacttgttgaatgggtttgataaaaatgctgacagtcatatgaacaataaggtccaggctgagatggtttcagatggacatgagaaatttgttgggaactggagcaaaggtgactcttgttatgttttagcaaaggtactggtggcattttgcccctgccctagagatgtgtggaaatttgaacttgagagagatgatttagggtatctggcagaagaaatttctaagcagcatagcattcaaaatgtgacttgggtgctgttaaaggcattcagttttataagggaagtagagcataggagtttggaaaatttgcagcctgacaatgtgatagaaaagaaaatcccattttctgaggagaaattcaaggactgcagaaatgtgcataagtaacaaggagctaaatgctaatcctcaagacaatggggaaaatggctccagggcacatcagaggtcttcctggcagcccctcccgtcacaagcccagaggcctaggaaaagaacatggttttgtgggccagacccagggctcctctgctctgtgcagtctagagactgggtgccctgtgtcccagcaactccagccatggctgaaaagggacaaggtacagcttgatccgtggcttcagaaggtgcaagcccaaagccttggcagcttccaagtggcgttgagcctacaggtacacagaagtcaagaactgaggtttgggagcctctgcctagatttcagaggatgtatggaaatgcctggatgcccaggcagaagtttgctgcaggggtgaagctgtcatggagaacctctgtggaagggaaatgtggggttggagcccccacacagagtccatactggggcaccgtgtagtagaactatgagaagagggcactgtcctccagaacccagaatggtagatccaccaacagcttgctccatgtgtctggaaaatccacaggcactcaacaccagcctgtgaaagcagccaggagggaggctgtaccctgcaaagccacaggggcggagctgaccaagaccatgggaacccacctcttgcatcagtgtgacccacatgcaagacatggattcaaaggagatcattttggagctttaagatttgactgccctgctggatttcagacttgcatgagtcccatagccccttagttttggccaatttatcccatttggaacagctgtatttacccaatacctgtacccccattgtatctaggatgtaaatcacttgcttttgcttttacaggctcataggcagaagggacttgccttgtctcagatgagatgttggactgtggatttttgagttaatgctgaaatgagttaagactttggggggctgttgggaaaatatgattggttttgaaatgtgaagacatgagatttcggaggggtcaggggaggaatgatgtggtttagctctgtccttacccatatctcatcttgaattataactcccacaattcccacatgtcttgggaggaacccagtgggaggtgattgaattatcggggtgggtcttccctgagctgttcctttgatagtgagtctcacgagatctgttggttttaagaattggagtttccctgcacaaactctctctttgcctgctgccatccatttgagatgtgacatgctcctccttgccttctgccatgatttgagacctccccagccacgtggaactgtaagtccattaaacctctttcttttgtaaattgcccagtctcaggtatgtctttatcagcagcgtgaaaatggactaatacacctccctagttttagatgtcagtgaatcccgtttatatttttaccatctagacttcatgtctctagaaatcagtttttcctttgtaattcggcttacagtcctctgttgaagttacctttctgaaacttcgttgcaagcaatataatgaagttgtaaggagagtgggttctggcatagaaagacttgagttggaatcttggctctgtagaccaaaagacactgagtgggaatgatgatctacatccagggttggcaaatctggcttgctgcctgtttgtgtaataaacactgttggaatgtaaccacacccatttatttgtgtcttatacatgactgcttcctcctacaactgcagaattaagtacagtcatctatcacttaatgggggataccttctgagaaatgcattgttaggcaatttcattattgtttgaacatcatagagtgtacttatgtaaacttagatgggatagtctactacacacctaggctagatggtatcacttattgctcctaggctacaaacctgtacaacatgttactgtcctgaatactttaggcaattgtaacacaatgggaagtatttgtgtatctcaacataggaaaggtacagtagaaatatggtataaaggataacaaatggtatatttgtatagagcacttaccatgagtggagcttgcaggactggaagttgtcactaaggaatagaaattttccaggtgatatcaatttttcagctccattataatatctgagaccaccattgtggtctgtcgttgacctaaatgtcattgtgtggtgcatggctatagttgtaacagggatgataggacccacaaagcctaaattatttgctaactggttcttacaaaagaagtttgcaaatccctgatctttatcacagaagtgccagaagaattaaatataataatacatgaaaagaaaataccaatatacttgacattgtaaatgcttagtaattgtgagtgattatcattatcattatgattttagactttcaactcactgacctctgtgttgtcaattcacccaattaatcagtgctgttcattcctattattcatcttaaagactcacgctcatggcatagtgcaaatatggagttagcatttcatttttacctattttgtcttctaccataaccccagttgtcttctagatagttcttccttaatgtccattcctcaaatatcataggccctgtgatggttaatactgagtgtcaacttgattggattgaaggatacaaaatattaatcctgggtgtgtctgtgtgggtgttgccaaaagagattaacatttgagtcagtgggctagggaaggcagacccaccgttaatctggtgggcacaatctaatcagtttccagtgaatttaaagcgggcagaaaaacgtgaagaggagagactggtctagcctcccagcctacatctttctcccatgcttgatgcttcctgccctaaacatcagactccaagttctacagttttggaactcagacttgctctccttgctcctcagcttgcagacagcctattgtgggaccttgtgattgtgtaagttaatacttaataaactcccctttatatatatcatattagatctgtccctctagagaagcctgactaatatagattttggtaccagaagtggggtttttgcatgcccagctccatgccagtgaaccaggcttcttacgcatttaaaatttgagaataggttgagatcgctttgaccctaagacctttaatcattttctttactgaataaaattgcacggggtgagggctagtatgatgggaaaggccaaatggaagccattagagctgcatctacctagaaaaatagtaaatcaaaaacaacattgcaaccctgaagggattgtggcgattactgccaccatcaaggacttgaaagactcaggggtggcaattcccaccacatttccattcatctctcccatttggtctgtgcagaagacagatggatcttggggaatgacagtggattatcataagcttaaccaagtggtgactccaattgcagctgctgtaccagaagtgattttattgcttgagcaaattaacacatctcctggtacctggtatgcagccattgacttggcaaatgcctttttctccatttctctccataaggcacaccagaagcaatttgtcttcagctggcaaggccagcaatatacctttactgtcctacctcagggctatctcaactctccagctttttgtcacaatcttattcagaaataccttgatcatttttcgcctccacaagatatcacactggtccattacattgatgacattatgctgattggatccagtgagcagtcttgcaaacacaccggacttattggtgagacatttgcatgccagaggatggggaataaatctgactaaaattcagggaactcctacctcagtgaaatttctaggggtccagtggtgtggggcctgtcaagatactccttctaaggtgaaggataagttgccacctttggaccctcctacaaccaagaaagaggcacaatgcctagtgggcctatttggattttggaggcaacacattcctcacttgggtttgttactccagcccatttaccaagtgacctgaaaggctgccagttttaagtgaagtccagaacaggagaggctctgcaacaggtccaggctgctgtgtaagctgctctgccatttgggccatatgacgcagcagatccaatggtgcttgaggtgtcagtggcagatagggatgctgtttggagcctttggcaggcccaataggtgaatcacagtggaggcctctaggattttcgagcaaggccctgccatcttctgcagataactactctcctttcgagagacggttcttggtctgttatggggctttgctggaaattgaacatttgaccaagggtcatcaagtcaccatgtgacttgaactgcctatcatgaactgggtgctttctgacccatccagccataaagtgggtcatggcacagcagcagcattgtatcatcagatggaagtgctgtatatgtgatcgggctcaggcaggtcctgaaggcacaagtaagttacgtgaggaagtggctcaaatgcccatggtctccactcctgtcaccctgtcttctcaaccccagcctgcactaatgatagcctcatggagagttccctatgattggttgatagaggaagagaagactagggcctggtttacagattgttctgcacgatatgcaggcagcaccagaaagtggacagctgcagcactacagtccctttctaggacatccctgaaggacagcagtgaaggcaaatcttcccaatgggcagaacttcgagaagtgcaccgtgttgtgcactttgcatggaagaagaaatggccagatgtgcgattatatactgattcatgggccgtagccaatgatttggctggatggtcagggacctggaagaagcttgattggaaaactggtgacaaagaaatttggcgaagaggtatgtggattgacctctctgagtggtcaaaaactatgaagatatttgtatcacgtgtgagtgctcagcaatgggtgaccttagcagaggaggagtttaataatcaagtgtatagaatgacctgttctgtggacaccactcagcctctttcaccagccacccttgtcatcacccaatgggtccatgaacaaagtgaccatgttggcagggatggaggttactcatgggctcagcaacatggacttccactcaccaaggctgacctggctacagctactgctgagtgcccaatttgccagcagcagagaccaacacagagcctttgatatggcaccattccttgggatgatcagacagctgtctggtggcacgttcattaaattggacctctttcatcacggaaagggcagaggtttgtcctcactggaataggctcttactccaatatgggtttgcctatcctacacacaatgcttctgccaagactaccatctgtggactcacagaatgccttattcaccagcatggtattccatacagcattgcctctgaccaaagcactcactttatggctaacgaagtgcggcagtgggcttatgctcatggaattcactggtcttaccatgttccccaacatcctaaagcagctggattaatagaactgtggaatggccttttgaagtcacaattacaacgccaactaggtgacaatactttgcaaggatagggcagagttctccagaaggccgtgtatgctctgaatcagtgttcaatatatgttactttttctctcatagccaggatttgcaggtccaggaatcaaggggtagaagtgggagtggcaccactcaccatcacccctagtgatccactagcaaaagttttgcttcctgttcccaagatactacgttctgccggcctagaggtcttagttccagagggaggaatgctgcgaccaggagacacaacaacaattccattaaactggaagttaaggttgccacctggacactttgggctccttctgcctttaagtcaacaggctaagaagggagttacagtgttggctggggtgattgacctggactatcaagatgaaatcagtctactccacaatggaggtaaggaagagtatgcatggaatacaggagatacattagggcatctcttattattcccatgccctgtgattaaggtcaattggaaactacaacagcccaatccaggcaggactacaaatggcccagattcctcaggaatgaaggtttgggtcactccaccaggaaaaaaaaaaaagcaacaaaccatgacctgctgagatgcttgctgaaggcaaagggaatacagaatgggaagtagaagaaggtagtcgtcaataccagctacgaccacgtgaccagctgcagaaacgaagactgtaattgtcatgagtatttcctccttcttttgtgaaaaacatgtttgtgcatgtatacacttgtactaagaaaatatctttattttatttccttttcctttatcatgtgacataagatgtactgacttcatataagcgtttaaatattgttaactttaagtaacagtatttgtgttggggattgttgcatttccggttgtttgaaggatagttgtattatgctaggcctaattatgaccttattattgtctttatttgaagattatttatgatctcaggagatgtttatgggttcaagttgacacggagtggacttgtggtggttaatactgagtgtcaaattgattggattgaaggatacaaagtactaatcctgggtgtgtctgtgtgggtattgccaaaagagattaacatttgagtcagtgggctggggaaggcagatccacccttaatctagtgggcacaaactaatcagcttccagcaaatgtaaagcaggcagaaaaacgtgaagaagagagactggcctagcctcccagcctacatctttctcccgtgctggatgcttcctgccctcgaatatcgaaccccaggttcttctgttttggaactcagactggccctccttgctcctcagcttgcagacagcctattgtgagaccttgtgattatggaagttaatacgtaataaactcccctttttatatatatctatatatagatcttagttctgtccctctagagaaccctaacagaggcctcaaattcttttttaaaaactttttcaattttgtaattgatatataatagatgtgcattcttttatcttctctatcaaatgggcttttcctcctcaattccaaatttctatgaaatgcagtattattgaagcagtcttgaaatgaagcttaaagatgtagagaacattgtaactcacaaaacattagaagtgtgggctttttaagccaaaagagaatcataaagttcagctgtcttgtttcttgtaagtctggaaatttctttccttcattcagtgcatcggtttgcagtgaaattgtatttattattctttttaagtgtttatttatttttctttttaagtgtttatttctcacatccatttattctcatttctacctaaccctttcatgcaaacattcattcctttatccgttgactccatcattcattcattccactgatatttatcaagcatcattaaatggtatgtattgagcaagacagtgaggatatggcagtaaataagatccagcacctgccctgcaaagttatgataaatatttatgcaaatctatgttcattagtaataacggaaactaaattctgacctcagtagtcaggcttattgcttattcactttttctcctccgtggctctagaattaagctttttggggttgcaaatgctttgtgttaggatatattcatttgtctctatttatatgagtctatggggaaacatctcttctacttgtaccatgatcttctcatagttcacctcaaaaattggcactggtggtttggttttaatctgatgattttcaaaaagcaccttgcaaatttcctggcattctatacagtttctttgactaacacttcaggatagaaaaggaatgggagcaagacgttgggctccttccttcaactagaacaatgtcatatttatcatgatacattaatcacttacaagaccttcaaggacagggttctgaggttttgaaaaatgtttaaaaaaattaatatcctatttacaataaaaattcacttttaattttgtatttcttcaggtaattatagttcaatatgaaaaatagtgataaaggtcttttatgaacatttaccatgtgatttttaattctcccaacaacaggaggtaccataattttgcctgcctattcaggtgaataagtctggggtcagatgggtttgaattgacttttcctatatcccctagcttatagggcagagccaagaaaaaagtctgacatatttgactcaatgctttgcctttaaccactctactcttctgctttatgtagtttgtagactgctctccccctttcaccaccctgcattatttcactctttcttttgatttttttttccaagtcacatgtgcaatagtcccttgctttttgtttacctttttgtgtatgtttgtttggtttctgttttcttaaaaaaacacaattgcatgcctctgattccttctcccaccaatctgtgccccacacttatcaaattaatctaccccaataccattctcttcatttctttgtcttatttaaaatcttctgattatccctatttcctacagtgatatttcccaaaacatgttctccaagctgttaatattctatgtaaatgaaagaaaaaggaagaaagaaaaagaaaggaagaaaagaaggaggaagaaaaagaagggagggagaaaaaaggaaagaaaaagaaaagacaaactcgtgagtttggaaagcactttcattacagaaagatttatctgactattatgttaatatccatgtgacagtaataaagaaatcatctattggagataaatatagaatagtttcaaaacttgctttctctaaatcagagtgtctgggtttaagtgacctttcccaatgttctatgttctttgtcaaatgacttcgtctctctgattttagttccctgatctgcaaaataagataatgattatgacctctgaaatggcctgcaattatcctctcacactgtgttcacacacttggtagtctcttcccccatgagaaaggaccgacttttatagcccataggatgttgcagagttgtattcaaagctgagtcatgaaagacactgtatctcttccttgctctctcttggataacttgttctggaggaagccaactgccatgtcatgaggatcctcaaagagcccattagaatgcctacgtagagaaaaagccttcaactaataaccagcaccaacatggcagccatgtgagcaagccaactgggaagtgcaccctgaggacataatcaagctctcagagtacttcagctaaggctgatgacttgactgcaactaactgagacatgttgagcctgaactcccagtcaagatgctaccaaactcttggcccatagaaaaggtgagagaataaatgttcaaagttgttttaagccagtttttagggtaatttgttacacaacaataaataataaatacaatgataatgatgttggtgatgatagtatctacctaccaaaaaacaacaaatgataatgcaagtaacaaacttagccatggtttagggcaagagtaagcattaaaccaaagttcaacattaataatagaggtaaaagtcatatgaagcatatcttaaatacatgatttcctctttttatggagcagtaaggaaattgtgctttctgaaatacactttgaagaaaccttctctagagtctaaatattctaggtgtttatatgaggcatccctatctgggtctcacccatttccccaaattgctctctaactctgcaaaaatagaccttgtattttgcacagtctacctctaaacttattatcccattcagcgtcataaggcttcctcttcatattcccttctgtcctataagacatgttttaaatcccaccctcatgaaattccacatatagatgatttctgtggggccaagactatgtgtgaggttctcaaacgtgggatcaagttttaattattcaaatcaccttggtttgaataattagacagtattacacaatggtcaagaagtagagaagtgcaggaatatacctcatatagctagccaaaaacaacaacaaacttttaaactaaaaacaatgcaaaaccagccaccacaaaccttagatagtaaatactgcaaataatgaaaaattagcagtgtaaaaaagtcatatgtagatatgaagaaggagttaaataaatacaatgaaagaaaaaaatatggactgtttggtagtaggaaaaaaaatccaagacaccaagagttaagcctcctgccagtttcctcttttttgtgatctgaaatctacttggtattttagtttcttttcctcagagaagaaagaaaaaagagaagaacttgaatattaaacaccattaaattccattaagaaattattttgagaaaatactttttggaaaaaaaattttttttttctgaatcaaccagatatcttttctcttaaggctgaagttttgtgaaaaacacatccagaatcaattaactaaagagttgttaaatttgttatttcgtatacttgagtaatgaagaagcctaaaatgttacataattagaggtagataacaatgtaagcatttatttccaatgtaataatttggtatcaaagagatagccaactctttcatgattatccaagttaaagttgtagccagtctgcagtgtgggaaaaaggtaagagaaaatatcctggaaagagtgagttgactgttgaaaatggttttctcataagggcaataatggtaaccatgaaaaaactttctttctttttttttttttttttttgagacagagtctcactgtgtcgcccaggccggagtgcagtggcacagtctcggctcactgcaacctccacctcctgggttcacgccattctcctgcctcagcctcccgagtagctgggactacaggtgcctgccaccacgcccggctaattttttgtatttttagtagagatggggttttaccttgttagccaggatggtctcgatctcctgacctcgtgacctacccacctccgcctcccaaagtgctaggattacaggcgtgagccactgcacccagcaaaactttcaaatggtattaatttgggactatttgctgaaaatggtggagccataatttgtaagggccagaactcacctcccacacaaactccttatactggagtgagtgagcaaataatcactgagatttcaaggttgctccttatagcagctaacatttcttaccctgacagaaaccgaggcccagaaaggtgactgcatgccaatggctctttagtgaagaaaaggatctggagacttcaccattttcttccccttatttttgaaaaccaatttgtaaaaggtctctgtttgcaagtaatcacttgttccttctcatagcttacctcagatgaatgtaaaaacttcattaaatgaccgtgacattaaaccaagtcattatatcataaaattacagtggcaactattcaaaaacatttagagcagcttcaaaatatagcacatctatttacctaaatgaagttacgttgctttaactttctacttttaccaagtaataggtgagttcaacctgacatgatacaaagggtttcacagtctcaccagtaagaattcatgtacttcagacaatcccgtctctccttccccacacaatttgttctgcttgaaatttaattttatgggaatttcttactttaacaatctcacaatgtagggcatagtgtctttaaacacagtcctaaatagaaaccctaataaatcaccatgttttggataagagccatgtctacagtataaattggaatggaagataaatgattctgcagagggacattcacctaaataggtttatcctcagtaaaaatgacaattccctacctgggttgtaggaatataatggaatctccagggaagttggaaagttgagatgtcagtaaagtgaaatcaagtattttctattcaatagctatgcctgggctagttccgaccaagcgtcaaggataccaatagcaaaagactaagcaatggagacgtttatagccacattttcttcaggtgaggctaagatgaggatagaaacagaaatttgtatctggggacagaacggtcaagagcaaaaggcgagcaaaaggcaaacaaaagacaagagcaaggccatgctgtcccatttaggagggacaaagggaggtgctgactcagcccaaaagagtaaccatgtcagaggagagaagaggggtctaggagaacagaggaaggagaacatgggatgtaaaattttttaaacctggacttaaagtccaattctgctatgatagaatgactcttgggaagtcaccctttctctctaagcctattcctttatttgtattatggtaatacagaattgcatctgatgggagtttatcttaggcaaattcaaatataaacactctgttagaggaaaagaagtaatttaattagtgcaagagttctgctagccataaatggcaatagcatgtgtgccaaaaatctggactattgttcccgcattacatgtgcttctcacagtgtatgctagactgtaagcctgccgaggccaagaatatagtctctctgtttcatgactgtatatacaacacctatgataatgccttatatgtaagagaggtcataaatatttatgaaaagaggtaagaaagaagaacgggagggaaagaaatgaagaaatagcatgcatcttgctatactgaacatgtctctattttcttgaacagcatgagcccatagagaagccatccactttaccaggcatgagtggaagaaacagcaacgaatcctaatacttgcaggaaaactgagtgtgttggagttttttaaagaaaaaattctcagaggtaattttgactatatacaattttctctttatgtactttagaaccccactgccaaataagatgcaattctaccataataataattgtaacaacatctgcataacctaactcactaggctcatataagaacacaataagattaaaatctagaatggcactctgcataatagtgttgtaacatgcaaatgtcaggtgtaaatgatttgtataattatctggcaccacctactagcatactctcttctactgaattctgttaaaaaacacaacgactgtatagtttctttagttacctgacaaaaggaatgtctgcggttgaactactggagatgttgatacccgaaggttaggaaaactagcgaagggaggaaatatctgctactcatttcatcaactggatagccttatagcactattgacatcctcatctgggctctgtggggtttgtcacagagatgttcaccaacaaaagctattgctaccatcgttaagcttgtaagcatccattcattactactgtactttcttcattaagttcctttaacttagctctgtcctttttcctcatttctcagactcctccttttaagtaatgtttcttcagcttctttaatcttccagacctgtaaatgatggaatgccatgaaacctcagtcctcaaacctgtgaacaaaaaagtatctgagacaggtctcaatcaattttgaaagtttgctttgccaaggttaaggacacgctgctcatgacagaggctcaggaggtcctgatgacatgtgctcaaggtagtcggggttcagctttgattttatacattttaggaagacacgagacatcaattaatacatgtaagatgtacactggtttggtccagaaaggtgggacaactcgaagcggggacttctggaccataggtagatttaaagattttctgattggtaattggttgaaagagttattatccaaagaaaggaatgtctgggttatgataaggagttgtggagaccaagatttaattatgcagatgaagcctccagatagcaggctttagagagaatagattgtaaatgtttcttatcagacttaaagagtctattctatcagtctttaggtttgttttgatgttaatggtaatgaagcatgtctgaccaccttctcctccaccacttcccattatggcttgaagtagtttttcaggttaactttgaaatgccgttggctgagaggaggggtccattcggatagttgggagggcttagaattttagtttttgtttacagacccctttgctttctgcatttattttcaaagtagtcttgccaacctagaagatggatttaaatgccattgtatatgttatcccaaatgtataatacagcttacacatgcctcctgaatggtagataaagtatcaaactatctacctcccatttggaggtctaatagatcacttgaacttaccaagtctattaccaaactctttattattcttctaatgcctgcccagcctctctctcaattcagaataagactcaaagtcccctatagggcattacataatgtgatgtcacactaattttctgatctcatctcatattgcatttccttctacttggtgtctctcatcacagccagtacaattatacctcaggacttctccacggggagttctctctgcctggaatcctcttcctccagataacgatgtggcttattttctcacttcattcacgtttctgggaaaaataatctctaattgaagagttgttttctgactactttatttaatatacaaattttctccacgttagttttgtcactctttatccaatttttctgctttatttttctttgttgcactcattattgtcttacatataatttttcttcacctcccatactggactgttaactccatgctcatagagattttgcttatttaaatcctatatgtgcagcttttagcataatttctgactcatagtaggaattcaggaaatatctgtgaggtgaatgaataaatatatttttagattttctttatacataaaagtgtctattcaaaaatttttttcagataatgctgtctttgtggttctggaaattgctttcttacttagtaatatgctctaagcatctttctataatacatcaccaaatatagatctaaatcatttttactagtctcagagtatttcattgtatggaggtgctgcgattgatttattcaaactcaactgatggacagttggattgttttccttttttttctatttcaaacaatgctttaataaataagcttatattgaaatcttttgtaatgcaattcttcaagcaattattgagtatctgctatacacaattcactggcctagacaatgggatggtaaagtagagacaaatgtgacatggttcctgcattcagggagctcatgacctactcaaggagacagatgatggaaaataagaatgacatattttagagaataatagagtatagaattatagagtactgcaagggcagtagagaataggggattcaggaatggaaactatcaggagatgcaagattcagaaaagctttttggaaggtctgtaagtttggcctgggctttggcaaaggtttcaaccagcagagggtctgaggtgaagagagagtgctacgcatttagaggattgccagaactattcttgcatagtttagctctctagtttgactggaacagaaggtgggtgagcaacaaggtcaaaaatgtaggctggggcaagagcacctaccaggtcccaatcattgtcaagccaaaagatccagggataaagaataatgtgggaatagatccatgtgacttacccatcagactttttcctttttcagaagaaagtttgtctgggctctcctggtctgtgggtaaacagactcattattcccaaatgttctggtatttgaagaaaagctagaaatctgtattttttatgtttattttttatttttgagatggagcctcactcttttgcccaggctggagtgcaggggcatactctcggctcactgcaacctctgcctcccaggttcaagcaattctcctgtctcagcctcccgagtagctgggactacaggctcctgccagcacacccagctaatttttgtgtttttagtggagacggggtttcaccttgttggtcaggctggtctcggactcctgacctcagatgatccacccaactcggcctcccagagtgctggaattacaggcatgagccatcgtgcccagccaaaatctgtgcttttaaaatatgaaacctcctgacttttaactgctgaccattttgtcttattttttcagaacctcattttgtgaaccataaaacaacaacaataaaattcccaatcgacccactgctaatgggctgtatgtatcctgtgaaccaccaatttgtaaattctgccctaagggccctgaggagactctgtcccctaataatggtgaatttcattctttttggaccttgaatatgatagcgaaattccattttacatcataatctaagatgcacatacataagcaaatataaatgaaacaaaacttttagaaaacagtacttaatcctaacaacttacttaacaaaaagaaaagcgctatgatttagactagttcagttcattctcttctgttcttccaaaaagaaatctttcttttaacctacacagcgaacttcaggactcaccatgattgcaaaattcattgaaaacattgtcctgactataatgcttcttttgccatctaaacctatgtgattttgtaatacctcttaggagtttccttctcaggtgtttaggaattgtggatccaactagaacataaacagctttcaggcaggatttcctcctttctcttagatccacaatcacagcaaatgtagcaattattcaacaactggatgttggaatttgggcctctgagattctccccaagtcagattttatagtctgagtttcaaaggccttgggtttgtaaaccgattccttgacgtagctggaggagatggtcattgacttttacttagaaaaccatttgtcactagttcatccagcttccctccaaaaatgtgtccctgaacctcagcctgaaattgaaatcctctttatcttgaggccaaattggctccactcctacagctcctatctcaaccccaggccacgtccttttgttggattgattgtgaaggccaaatcataagttcttcctattttatgctttatataatgtgaaccctttctggttattaagaaacacaaatgattttagttatcatggaattaaatgtagcctagaacattcaatatttgtcaggtcatgttgcaaatgagctactgtattcataatggatgtgtcaccatcataaatatgacaaaaggacattttcaaaagatgattatgcgcaccgatgggagagaaatatgagctcaagaaattaacattctcatcactgccttgctcctctgctttgcattatttaaggatctctggtgacttgactgaagtcctccttgtcccctaaagccctcagtgtgccaagcttttggagtatagcccaccttgatatcaaaagaaagacccctgttggagaagttgacatttccccctctcatctctaggttaatggggagacctgaattcaaaggcaccttcgtctcagtgggagcaccttaagacatcttcagttttgatttatattgctttcaggtacatgttggataaaagctgatgggaatgggagaaagaagccagatgcagagtagatccaagggaagaaccgaaatgcagaacattttacttctttgtttagctatgctgtgtattaactagccaacactgtattgaatacttgccatgcacaagactagttgtcctccactctcttgatcactcaaatctcctggggagctttttaaaactaccaatatcctggccccataaagactctgattcaattggttgtgagtggggacccagcaatatggaagttttaaacagctctgcaagaggtttgaatgtgcagccatggttgagaaccactgcattagatgctattcataaactttaaatttttagcttgttcatcccacaggtctataaggttgctattatcattatcctcaattttcaggatttttacctctatttagtaaaataaaggtaaagagaagttaggtactatgcccatgtcatacaggctggtaaggggtggaatccaaacgtgagtctaggtagttggatttcagagtgcaaagtaagtttaatgcaaagatcaaaggaaggaggaacacttatggtcaggcatttgggacagaagtagcaaagggctgactacataggtggataagttatagcaatggagtctccattgtatatacctccaccctaaaggaatatgggaaggagagtgcttaaagtctatcagcaggactggctttagagtgtacaacctgtgcatgagctcaaaagggtcccataccttgtttaatgctctgctgttcctgtcttgaaattcttaataggtttgaaataagaagctccacattttcattttgcactggaccccacaaattattaatatgacactcaggccagtcctgagtgtcagactcatggaaatgaaattgtagccattttttctagtttgaatgctgtgtgtgatgagaggggtggttgcctctctgcaggggtttcagtggaacagcaatccctgccaccctttctttgtgaatgcacagctcctagagctggaaaagcaaacatcaaagtctctgacaaatggagaacagagctgtgagttgcacagattaaaatatagagtggggagaacccaaaaaaaaccagtggtgtcctaaaaagtcctctatgcattgctgcactgaatctttacaactctagaagatgagaatgagtgtgaacctcccaggttcgcgccattgtcctgcctcagtctcctgagtagctgggactacaggcgcccaccactgtgcccggctaattttttgtatttttagtagcgatggggttttatcgtgttagccaggatggtctcgatctcctgatctcgtgatctgcccgcctcagcctcccaaagtgctgggattacaggcatgagccactgcgcccggccaactattttatttttattctatcatcacccattcaacagttactcacagggcaccttcagtaccttaggtactgttcttctttcttgaatttaaaaggggtgaggattcagtgagatgatgttgtacaaatatgacctgttattacctggagtcttctcctgccccagtttggctgttcactgagttcccaagtgtgacttgtgattacgtggtcagctatctcctatttttatttatttatttattttttacctttcaacttcatacacttcctttaaaactgagatcaaatttataaacctgactcattatgaggatggtgattctaagggtagctcatgtttttggagtatgtaatgtgtgccagatgcagtgacaacaattatttgcatcagctcatttaatttaacccttacaatagtccaatgagataggtacagaaagctagggaaggattaacaagtttctcagtatcactcagatgccaatgctagggcaagacttcaaaccatatgttgcatggcattaaagaccaggctcttaaacactgtagtactgaaacacttattctatatttctattattatagaaatcgattatatatacatatttatattacatataaatattagtatttcacttattattgaatattgattccttcagtgttattgtacactgatatggtatgtatgttatgtgttagcttccaagtgtctagaagaagctatatttttacacttaatgtctcaggtagcatttgtaattgtgtctttcatggtgcagatattaaaacatactgattgactaaaattctactggaaaatatataatacctaatcattggtcaagtaaaaaatctataaaattgtttatgtaagatcatagtttttttttggttagacaccaatttctctttgcctgaatttctagaattgtatttagaaaaatagattacttagtaattttaacattccaaaaagagcggttaatattatttaagcatttttccatatcacagttattatccaagtgctctacctatcttaagccatttaatctctactaacatggtggatgcagtttgtaattcactccttctttcctgacttactctgggtatttagatttcccccttgtggcaactgtattagcctgttttcccactgctgataaagacatacccaagactggataatttataaaggaaagaggtttaatgaactcacagttccacgtggccagggaggcctcacaatcatggtgaggtgaaaggcaggcaagagaggatgagaaccaagtgaaaggggtttccccttataaaaccatcagatctcgtgagacttattcactaccgcaagaacagtatgggggaaacagctcccatgattcaatgatctctcactgggtccgtcccacaacacgtgggaattatgggagctacaattcaagatgagatttgggtggggacacagccaaaccatatcagcaacaaatgcttcaggggaggggagcctgtccccagcttcaggatgggtctgatttgtttcctgtctccttgagagtaactggtataggaatccaggacaaccaacaggacgaattgctgcacagaagaattggcttaggaaagagtgtgcatctcagtccaggagaaggagacaagacacaatgtttacagggagcatttggaaaagtgaaagccacaggaaaagatggcttctctccaccaaggacatcaccatgttagaactaaggcagctttctcactatcagctcaagaatgaagctaagagagaagagagacagccaagagaatcacaaagaaactgaattcaggccttaattagtcttccctatctctagaattttcagatatgtaagccagtaaatttccttgttgtttaagctggtttgagatgggttttctgttccttgcctccaaagccatcaaactctcacatggatatcaaatgttatgttatatgttagaattagatataagaagatacaccagcaattgaaatatgacaattacagaaatgctatcatatgacatttgcgtagtgctgtacaagggttgccaaagcattatgtgtaacaagctcctgatatttcagttgtaaactatggctattgaaaaagagaaaacattgccgaccaacatggaccagccctgcctttgccaataaaaagctgcttctccccaaatatgaagaagatacatgggatatgaccgtgagtgcaaatctcctgaacaaattccctgtcctgcaagagtctcaatgttgtgtcaagtacgtggccatcttccctacttgacctggttctgaccttgtgcttacttgtacatacttggataactgctagatgcacttccctagaggagctccctgtaaatctataacaaaccatgtcactcacaggagcactcttgtagctacagattgctcacagggccaaaagcaacttttgcacgttttcagattagtgctatggttttgctggccatgttgccttagtctgagagatggcattgaatctgtaaatggctaaatgcccaatcttttcctgattccctcattggaagtgaatccttcctttccccagtatcctgtcttttgtacttgcattgcagcattagccagagttcatcttaaatcagaattatttatgcaaatgattgtcttcttaacttgattgtgggcaagttaagagctaaagacagtgtctcaatttcttttctagtctttggattatcaaagagtggacctgctggttgaatgtaacataagatcaaaaagccccagaaatctcatggggggctcatggactatgagggctcataaacagatgttgagaaccatgcagtagagacaaagatgatgtttgagtttttacaatatatttacacgccagagaaatacaaatacaaagctaggtgtcgttccttctcttgatgaaagaaatatcgagtagcagatatttataattttttattgtatgtatctaaaaatattttgatatttgaagagtatagaaaataaagataatacagagacagagcttatagaattactgtcactatagaagctgaaaatgccaggcactcacttattctggcaagggctgttgtacagtcagggcaagggctaatgataggcttggcaagtcaggcacatccatcccaggctttggtgacttaggatctcccactagcagaccttgaaacaaggtctttggctcatgtgtttgttttggaagtcaaccaggaagctcaagtgaaggaatggggaaggcgaaggaggggagagagtgaagcctgttaaaaggaatgttaatgagtgggttactgctgtagacaggtgggtctcaatcttcccgagaatcatcaaaaatcttctagaaagcatagtagaagtgctgcagtgagaagcggggctatttattcaccaacttccactcatcattggttgagatttttcccggcacacaggctagtggagctcttgggtacataaagtcttcaggtggcaaagtagaaagagagggaagatgatggcatgatgatggacatgatggcaggtcagctcagagctgtgctgcggagatatgaggtgggcagggtattgacagcagctgcctcattctgggagccagaagcaagaagaataaaactgggggaatctgctgtggtggtgcaaccctggttgaagcactcagggtcttgaatcagcattggctcccaggatagagtgctaaagtggtggcgatgcactccaaggttatttcgtgtaatcttcacaactctgccatattgggtgaggaaaaaagagagccttagggatgaaaaattaacttgtgtaaggtcatacaactactactgtagtaaagataatctttcaaggagtgcaaaacagataaccaacaatgataatgattcttaatatttagaggtaattaagacaataataataataataatatcattatgatagttctttgcctgtgtagagttcatatcaatgtgcttttccaaacatttcatttattttgcttcattcatggggaggcatttctgttgtcttgtatagatgggaatactgagcttccaacatgcaataacttgccaggaagccatggaattaactgcagtctaagcacaattcccttcccagagtgcttaccttccttcatccctgtaggcagcagaagacaaatgtactatgcaaatagtacaattcatttcttttgcaggtgtatgtctctctgtattcaattctcatgaaacctttcatgaggttaaagtacctgtttgcagaagttttggaaagccccacagttgcaaaagtaaacacacaaccttcatacatattctagtctccttagcatagcaaaccgttgatgtaaccacctgctattctctgggggaaaagaaagatttagagggaatatgaaatctggagaaatggttccattgagaattaaccctcttttaagagaagtctcaggctgttacaactggatatgtatgagttttcattcagggcttaaaatagaacaaaattagatcttatgaaagatttatgaagcagcaatttgctcatctatgcatttggattttgtgtgtgttctctcattttgggaagtgcagtggtaaaagtgaatggcaatgaccaaacttagatattttgactgtgtgcagtggtccccatcacctatagaaatgtgtggttctgccaaggcaagtgatgtaaggctggaggatggaaagtgtcgctgtgcagtcagtatctttttatcatcagccctcaaatgcattggggtgcatgtagttttaaatacacatgaaaccatctggtcaattaagtcatcatctttgtacttttgaccagttagcttttttttctgatgtttttatgataaaaatgaacatgagaagtaacgaaatgttaggtctagatcatcatggtgtcacagtcaagatcaagaaagagaatttcccttgcccttcttccttgatgtaaaaatcaaaaagttgtgaacagaacagtaaaaaaattgttattagtaactggtatcaaataacatgcataattgtttatttggaatcaatatgttttacaaagcaccaataaatcactgtgggctggttggggctgcatcaagatgaacttttatgcagagtgcctataataaacagcaccgggctattctttaagttagctattccgcttatttgttgctgcttcatgaatgaagccacactggactaggtggcttaagacaataaccattttatttatttggtcccaaactgcatcagctggggcagcttgttgaaggctggagaatctgcttccaagatagcctcagccacatggcagggaaatcagagctgcctgttggctggggtattgactggagctcctgatctgggactcagttcacacgattaggttggacttagcacagcctggcacttttaggatattcagatcttacatggtagctggccttccccagagtgcaaaagcagaggatgatatacattcttaagacaggcacagaacaggcacatcatcatttctgttacattctgttggtgatttgatttaaatacggagaataaatcctctatttctctggaaggattgttaaaacttgggtaaaatttttaacatactattatcattcagcacatacacagaatcctttcttctgagcggggaacaaatgcaacctaggaatggaggaaaatctctttcattagaattcagactaagtatttctgaatacacctccatcaaacatagttatcctcaccagcatcactaaaatttgataatttgttacaatacttaactctctggaaatatatcaaagttcatatctctacccttgctaataggacttttaaaggaaaccttgtgagttcatgccctaaaataatattccctgttgatcaaagtatcaggccttgcaaatttcatgatcattcccataattaagatttctgcctgaggttaatttccctagggactgcccaacttcttgggagggatatttcctaatttatgataccttgttagtgagggtttctgtagcatcagggaaggtttctaagcctgtagcctgagtcatgacaaaataggagggtagctaacaattattgaacactttctatctgctgcatgctgcgtagaattatcataagcctgatttttttttcaaaagaaatcaattgtaatacaaaatagcaagtcatatgaattatcagtggtcatttagctaggaagtggcagaacaggattcaaacctggacagctttcattgcagagtctgtgtgctgacctccggcagggccatctgcaatggcgagtcactatagttgggtggttctcaaagcgtgtttatggaccagcagcagcagcatggcctggggacttgtgagaactgcagactcttagccactgctcagagcgagtgaatcagaaactttggagacgggatttagcaatgtgtgttttctccatcctggtgattctgatacattctcaaatttgagactcatgttttaaaaatcgtcacttcaagaaaatgctgtattaatcatagggctgactgattaaagctatcatgccataggcttctcaaggcacctcaacaaagaccaacatccttcacagaaatgatccacattcaacaaacattctagctgtagcttgacttaatgatcatgtctttcgcatttggcttggaatacaaattcactccatttcccaactctccagttggttctatgcttcagtttcctcatattaaaatatacataatgatgcttgttctcttctctcacagaaatagtctaggaattaatgagctatattaaactcattcagttcctggaagaaaggcagtatataaacactatattaatattttaagcaggttaactttttccatgtgaataaaagccttttttcttttggtcatcaaacatgttgctttttctcaaaagaattttttgattctttaaaagttttcttttttaaagataccaaccagatttctttccaagtaccaaagggaagagtatcaggatgagaaaacatttttatgagaagagctaaagttttaaaattcctggttttattagcgataagaggcagtgtggtgttatagcaagaacactgagttaggatgccaataatgccaagtttaagttctccatgctacttttgaggtgtgcaaactagggtaccctcttccactttttaggcctcagtttactgaactataaaaagtggcaatataccaaagaattggagtctaggcactggcctcaaaaacctgggtgtgaatcctggcttggccattcattagctgtgtgacctaagattagttacttactttccttgatcacctgtctcctcatatgaataagaaggagagcaacataattcaataaggaaatgaaaccaaggagctcagcttagtgcttggcactcaataataagccctggctattattaacattaataaaaattcaggtatagactagatcatcccagaaggcctggctgctttggaattttaggatcctctcagaagtttctcccagaatctccagttgctttcttccctaaggattcaacattcttcattcaatattcttcatgtatttattgagcaccgactatgcaccaggaccattagaagcagtatctctagtgaacatagagaaaaatccctgccctcgaggaacttaacatgctagggggagcaggcctttcataaacatactactctaggtacataaatactcaatacatcttgggccaattgaatggaatttctttttgtgttgaaaaatcttcaacctagatagaaaactatttttcttagccttcatctattcagagataaaaacctccctttgatgagtgcttgagagctctgctcttatatttttttaattctatttttaaagtgaaggcttccctcttagtgaatgagtaaaggaaggaggtgggtggaggaggtgggaaggaagtgggtgtcccttgcttcatcttgcctgaattgagggaagagttgacaaattagggtaggttgggagcatgacaacttggttaacaggaaacagaagatattttgaaatctatctgtttagttgccaatccctgtttgcaggttaagaagaaagaagttttgacatttgggtaccagtttgtgcaagggagtccacatctatccagaagttttgggaaatctgaaatgatgttgtcccaacctgtttggaggaggatgttgctaaacctttctggattcagagagaaaatcttcctcctaatgctctttcttcatgatacaggaaaaacagtgccagatctcggctgacataaacattttaagcaggaaggagtgcacttcttctatttcttaacaacataaattaaacatcacagtagacatcagcctggaaaaagttacaggaacccaaggttctttcagcagtttattaatgcagtctggccagaaggttcagaggggcagtgagatcaccagctggtatggagccctgggtgatccacagacagttggctgggactcaaaagacaatttgttctggttctgaatgctgtattttgtgcagcccacttaggtctagagatgttaattggaaatacaggcacacaggcaggaccaaggaaccttatcagccacgtgcagcagcactgaaccatggtcaggagaagctgggaagcatcaagatcagaggtcagactgggctggtgagagaagtggccaacgtggtacccagactacagtagaggctgtgccaaggtgcttgtccacatggaaaaatggcatacagtttacaatgaggcctgacggcagaataagctcaagtctagattgccaggctgagttggagaccaatttggtctccaaggagacatcagggtgtagcagatgtattagtttctgagagctgctgtaacaaaactgggcttataacagaaatgtaatctcttatagttgtagaagctagaagtccaaaatgaaggtgctggcagggttggttccttctggaggctctgagaaggaatcagttcatgtctctctcctagcttttggtggctgcatggcagtccttcatgtttcttgacttgcagatgcattactccaatctctgcctccctctttacatggtcatctcctcttgaatctctatgccttttttcttcttataaggaaatctgtcattggatttagggatcatgctaaattcaggatgatttcatcttaaaatccttaattacatctgccaagacctttttaccaaaaaaggccactttcacaggttatgaggtttaggaggtggcatatcttttgaggatgccaattattcaacccactaagtggatatacaggtagaagtcagaaaacttgggtttcaattctaataatatgacaatagctatcctttaagaaaattttaaatcagttgtcaagcactcatttatgatgaacaaatacactgttctaggttctcagacttaagtaacaaaaaaaaatgacagagatttttgctctcataaagccactctctattgggtatcgttggagacagacagataaataagtcgaagcatatggaatgtctgatgatgatgagcactagagagaaagtaaattagggaggaggatgggagtgctggagtactggaaggtggcagttttaaataagatggtctttgaaagccttagtaagagctaccatttgagtaaagtctccaaagaagggatggatgagcccggtagatgcctggagaaaaagtctctcaggtacagggaagagcaactgcaaaggacctgaggctggaacaggcctggtccttttgagaagtaaggaggccagcaaggcagaaggggagcgagcaaggggaaaaagtggaagaagatgaggtgggagagataacagggagcagattatgcacacaggcctggctgtttcctgttgggactttttgctctgagtggaatgaggaggcatgtggttcttcatgtattctgcagctggagcggctagaatatgctgaatgggaagccataggcatgacacaacccgatcccatgattgctgggtcacttctgcagctgtatggaaaacagactcatgtggaggcaagggtagagcaggaagatcatagggacaattgccctagtgaaggggagggatgataggggcttggaccagtggagattgggagaagtcatggggttcttcatgtattctgaagctggagctgctacaatatgctgagggtttaatgtgagggataaaaaaaggagtcaagactacctccaaggtattgggcccccaaaccagaaacatttattgagatgaggtggtgctaatgacttcacatgcattagacaacccattgctcagccctgtaaggttggtaacattatacccattttacagataaagaaacagtctttcaaaatttaagtaaactgtctaagagcatgtagctattaatagtacctgaaataggatataggccagttctctcatatttataatcccagattcctaactctcagagctccagctttttcctctgcataaagaatcttcttatctacatccacaagattgtgagagttatgagaatgaaagtaaaagtgctttataaattacaatgtactatccaactatgtatcagttatctatttcagtgtaacaaaacactctaaacttagtgatgtaaaataacaatatattattatctgttaaggttctggaggtggactgggctcaacttggtgcttcttgctcaaatctctcttgtagtttcagtctgatactgcttaggctagagtcatctcaaggtctcacttatgtatctggtggttgatgacggcttttggttaggacctcagctgggattgttggctcgaacatctatacatggcttctccatgtggcctggacttccttacagcatggtggccaacttccaagagcaagcatccctgaaaagaaataattaggtagaagctgtgttatcttttatgatctagccttggaagtcatataggatcacttctgccatgtatactactgatagaggcagtcacaaatttccactgggttcaaggggaagggatatagacaacatatctttatacaggagtggcaaagtcatatattcacagcatgtgggatgggagatactgttatcaccatctttggaaaatacaatctacaataaagtagaagatattattacaagggaagtttatcaaggcaagaaggctcgacaaaatgagacagattgcactctcagtgtaagccaggcacaagcaaatgcagaaagaaatgtagagaaggtaactagaaacagtctcccagggtagtagcagagtaagcagacagcattacacagccagatgatgatggatatctgggcccagatccagaaaattctgctcattgttgcatttttttccccatcttttttatgatttgttccggaacttatgaaaagagctccaggtaatacatcttatagaaaaaaggaaaagctacacggaagcataacaaaaaacaattccccatcattccaccacacaatcggaatccatattaatgtgctggtgttgggtatgttgtcttcctgggtggagagcagtgcagtgagtaagggctttgggcttgaaaatcccacaaacctggttgaaatcccagttctgtctcttttagctgtatgatctcttgggcaaattacataaccactctgtgcctcaacttcctagtctggaaaactgggacgatactaaaataatcctataatgtggcacaggggctggaaaatagtaagttctcaatgcacattagcttgtaaaatcactattaaataaatacatgattcttttcacaaaatgggatcatttgcaaaacagcatgcatgctggtatgtagctgcttttttcacttaatgaatttatcttgaataccttcctatatgactctggaagcagaaacttgtatcattttgtttatgagatgcacatcctttcattgtgaacatgaattacaatttgcctatttgtttaacagcttctaattgatggatatttagctttttttttaaagttttacctattatgtatagccctgcaatactcaagtacttgtctaaatattttcttattgcttggaatattttttcaataaacaaatgaatattgacaagtttctagaagtggacttactggccccaaatgtcccattcagtaattttaaatttactttttattatgaaaatttcaaacccacagcaaattagaaagcgtagtacaatgaacacaaacatgtagctagcaagtatattcagcctgattacattctgccatacttgcttggtgtttgtttttcttaagtattttaaaataaaacatatgcatcataacatttcaccctactactgtaaatctgtgtctcataaaaatgagaacttctcctgtataattattgtacctaacaaaattaagtgcaattccctaatatctaatatacgatccatttaaaaaattcccaatggtccaaaatgccattttcagctttttttttttttacattgaacaccaacttttaatttttacttttttttgattttttttattattatactttaagttctgggatacatgtgcagaacgtacaggtttgttacataggtatacatgtgccatggtggtttgctgcacccatcaatccatcatctacattaggtatttctcctaatgctatccttcccctagcccccatcccctgacaggccccagtgtgtgatgttcccttccctgtgtccatgtgttctgattgtttaactcccacttatgagtgagaatgtttttcaaattaggatccaaccaaggaccagttattacgtttgattgttgcatctcttaagtgtctttccatcaagagcaatcccttccgcctttgttctcctctttaacattgacttgctgaagagactgagctgttgatcttctcctcttgtaaacattaaaaactcctgtttctcaaagaaaattctcggatgtgaaatcgttggattaaaaggcccatcctggttgcaggcttcttccaggatgtgtgagccctttgcttgcaggtgtgggctgctccaaagtgaggctctcctcagcagatagatgcccttcattgtcaaggctggctctagcagggcacttgggaggccccaccctttccacagggatgttggggtccaccgttcagtacaaagtctcttcagagaagaggcaattttggaagacttcattctcctctatcgtcagatgcaggtaagcgtctcctggatagatttgtgttcctgctggtggggtggatgacagcagacctttatagttagagatatgcattgaaatcctggttctgcctgttactagggtaacttgctaccttggaaaaaccacttaaatttccattgtatttcgccctctagtggaatgcgctgagtcctttatcatgcacctgtctatttcatacactactgggtagcaaagatactgccactgagaagtgggcaggtctcctaatttccacaacaggcctctcaaactttcatgtacttaaggaacacttttggggtgagggatacttgtaataaccagagatctctgagattctgattcagtagatgagacccaggaatctactttttaaatttgttttaaaaaaatttgtataaatttagggggtccaagtgtctttttgttacctggatatattgcatagtggtgatgtctgtactcattaatgaatttctcatctctcaccctccccaaccttcagagtctccaattctatcattccatactctatgtccacgtgtatacattatttagctcctacttatacataagaacaggcagcgtttgactttctgtttctgatggtctccagttccattcatgttactgcaaaggaaaacatgatttcattcatttttatggcccagtagtattccattgtatatatttcttaacaggcaccctaagggattctgacttagggaccctaagggattcagggactatgcttgaaaaaagtcttatctgggaacttccacttccttgttagtaataggtaacacttcatagcaattacagttgtaccaagcactcttccgaccacacacagtaacttactcaaccctcacaactactgtgtgtactagatacccatattttatacatgaggaaatcaaggctcagagagtttaagtaacttgccaaggttgacactgatagcaggtagctgagccaagtgctagcattctgtgacttttttttagaagtaacaaaataaatgacctggtattttaactttgagagatatggcactatcaacaaaaaataaccacgtggtattgctgagaatgtttgggtgataaggagctctgaattcagggctgccttccagaaaacaagctgtcagttttaagggtgagaattgatacagatgtttccagtgagaaatttcagtacctgaagattagacaatatcatcaggttttgctatttttttaactaatggaaatgtcctttccagtgttgttacattattcaatttgggaataagaaacacacgatactgaaggatgctttcagaaaccaaagttgagtctttggccgtcttgttctgacatcattctggtgaaccaatccagtttccttctacactctgagagaggatgttgtggtagggttgcctgttaaaatacaggacgcccagataaatttgaatttcagataaatgatgaatattttagtataaatatgtatacttataggtgtatgtatatatgtatgaatacgtctcaaatattgcaaatatctgtttgctaaatataacaactgtagattgtggtgcagggcaatgcttctcaaactttactctgtatataagtcagctgggaattttgttagaatgcagactctggggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactccgtctgaaaaaaaaaaaaaaaaaaaaagaaaaaaaaagaatgcagactctgagtcagtcgttgctatgttaaagctgctgttctaaagaccacatccaaaaggaaagtgtgagcagagatatttgttgagcttggctggaatagaagaaccacctgtggcgcctattgaaaatatagatactttgccataacaaagtactgtagtttgaatggcttaaataatgggaatgtatactctcacagttctagaggctggaagcccaagaccaaggtatcagcaggttggttttcttctcagatttccctctctgactagcagacagctgccctctcaccgcctctttacatggttgtgtctctgtatctgtgtgcccatggtgtgtctatgtgtcctaatcacctcttttagtaagaatatcggttgtattgaattaaagtatactctaatggtcccattttcacttaattacctctttaaagttcctgtctccaaatgcagtcattgggttaggattacaacatatgaagtttggggacacacaattcagtctgtaacaccatctgagaaccactgagaccagactttctgtgggagggactttcagaggctaccaatttggccagctggaagccctggttgaagaagaacatcccaggtgagttttatcaggtaaatttaagaaatctggtatagaatagtaattcttcaacttgagcatcaattggaatcacctgaagaacttgttcagcgccccaagattctgactgaagaggttaaggtggagctcagattcggcttcttaacaagaagacatgcttaaggacaccaccttagacacatccctcaacctctctcacaagcggaggcaggaggaacatactcatcacatggctgtggtgtggatttcctgagattaggaggcaaaagctcttgggaacttcagggccctatgttagaagaaggtgagtcatggtgatgaattttccaccagttataaagcatgcgaaccaaagtcaatgtattttcatgaatagcaaaacagtgtgtactttttttttttaatctttaacttttattttaatttccggggaacacgtgcaggatgtgcaggtttgttacataggcaaacgtgtgccatggtggtttgctgcacagatcatcccatcacctgggtattaagcccagaatccactagcttgtcttcttcatcctctgcctcctcccaacatcccctgacaggcctcagtgtgtgttgctccacaccccacctccaccaccatgtgtccatgtgttcccattgttcagctcccgcttacaagtgagaacgtgtggtgtttgtttttttgttcttgcgttagtttgctgaggataatgacttccagctccatccacgttcctgcagaggacattatctctttcctttttatggctgcatagaatttcatggtgtgtatgtaccagattttctttatctaatctatcactgatgggcatttggattgattccgtgtctttgctgtagtgaatagtgctgcaatgaacatacgtatgcatgcatctttataatagaatgatttatatttcttggggtatatacccagtaatgggattgctgagtcaaatggtatttctgcctctaggtctttgaggaatcaccacgctgtcttccacaatggttgaactaatttatacttccaccaagagtgtaaaagtgttactttttctccataacctcaccagcatctattgtttcttgactttttaataattgccattctgactggcatgagatggtatctcattgtggttttggttattagaactttcttattattctattcatggatgagtcagcaaggtgtccttcattcttgccaccatagtggtctttattaaagagcacattgctagatcccatgaggccagttttccaaatgcgatgcgagttgaagataaaatccacctagtttgggaatggaaaagagttgaaaggcctccaaattatgtgattaaacctgcaatctcctgagaaactgctttcttgttacaactgtggttcctgagacacaagttactttgatgttgatcatgttaataaacttgtaaataaagtcttgcagaagaagaaatcaatagctttgcttacaggcctctaaagcacttatgagagtgaccctctctggtgaattaacattcttgaacttcaccaatcctggtaaatacagaggtcttaagaaaatgtacctttctctatactgtagttttatgagtttcttactaaaaaccagtactctgccattttctttcttttctaaaattggatgttaatgactagctggtaagcatttttaaaggtcatatttataataacagggctataagttgagcttagtcttcagtacaatgggtttaagattaccacctattaattcagtgagaattaaatgtgtgcaaagctgctactatagacttcgtgaagtataatagctccataaatgacattttatttgtatggttatatacatctaaatacgttgtctttttctgctcatttaaacttcaatgctttcttcttttttcttttctttttcttcctttctttgctcttcctagccaattaatcaaatcatgatgtatatcttaaaatagcgtattttgaccagaaaaattgtgaggagggctttttttgttgttgttcaatctctgagtgataaggaaacagaggcccagagattaaatagcttgatcaaggttaatcaaggttaagacagagctgactttgaacacaggattctgatcccagcagtattggagcccttctgttttctcctccagatgtacactcagcttttattttttccaccacactcttttctcagaagactgagcatttgggatgccttggagaactcccttgctttctggcttcctgttgggatcagccaatggggagcacgggcaggacatggggcaggggttgggggtaggaaagggagactggggtattttattccattgggttccttctcaaagggatcactttggactggctgtcaccttaaacaaaaaccacagctcctaagaaggtggccctctctgtaagtctttccaggttctgataacagttccctcccattgtccccttccagctaagaagtgggaacagctctgctggcactaacatcacggtactgttaccgcttttatagttttcttgcaccctctgtcaacgattccctcatcaaaactctcctcattattctatttgactatgccatttgtttcccactggggccctacctcatagactccgacttattcacttccttaacacttcactggacttggaggatatttaagggactgcctatgagcaacattctgattctatccatagctcagataagcgtagacttcctttgttcacagagggaattctgccatggttgctctctccaaggcacaaaaggagagatggaaagccagctggagttctaacatttaccttctaacagctgcctccttcatgtgaaatctttgaagaaaggctggcccaacccagatggcaaagagcagataaattgaggatgatcctagggactaaaaacttaagtaaactttgtaatttttatctgaacgatacaatatgattaaaatataaaggagtttgctcccaaggagaaataaagaggccttaactaggtccctgcttggcagcagaattttatgcctcttaatatttgcatggtcaattaatcccttaaagtgatgactagtaggcaatttatttggacggtgcaaggggctaattggtaacattgttacacaaaatcttgtgggcaaaaattatgcctgtctttaaaaaaatacgcctttggtatttgaaggcagagctctagtgccttgggcctcagaggaattcagactgctgatgtcagaattaatgaagtatatggaaacttaagtgtaggatggatggagtgaaaaatgcattaaagattaatgacattagactagtgggagagccacattttctggtgatcaaagactctgaggctttcatctgcaagtgcctgggagaatgttgaacatcttggaatttgtcatatcgcctttggttaaattcagcctgctattcagcaaagtgctccaagaaaaatcccccacccttcggggtctgatctgttcattcattcaagaaatcttttttgagtgcctactctgtggcagacattgattaagaaaaaaacactgaggtcagtgatgaaccaaaacacatacattttcttttcttatggagattccaatgtcgtgaaatagacaagttttcttaaataacagaatatgcatttgcattcttaggtaattatattttttggtaatattatattctaggataacaagaagtcctctagtttcaaaatatgtcaaacattggataaaatataataagaaacattttatagccaggcataatggtgggcgcctgtagtctcagttccttgagaggctgtggtgggagaattgctggagcccaaaagctccaggctgcagtgaactgttatcataccactgcactccagccggggtgacagagagagaccctgtctcaaaacaaacaaacaaacaaattaaaaaaacacgaaacatttcaaaagtagaactaaatgcctccaaagtcagagaagtcctcagtgaccagaaaaaaaaggaaaaataaaaacaaaaacaaaaaaacccctgaaaaccagagagaggagtggggctaaagttcaggttgccttgtctgtggagcgagagagaaaaatcctcacaggttatacataacagggaacaggtcactgtgtgtgagagtcagccaatacagtggacggtgtatttaagccttcaaactagggtaatgttccaaaggaaagcaaaattgtgttctggggcatcaagccagataatgtggcctaaggtgggccatgcctctgctatggaagcttcctagaagacactatacctggagtgactgtgaaaaataggcctggtgcagtggctcatgcctgtaatcccaacactttgggaggccaaagtgagcagatcacttgaggtcaggagtttgagaccagcctgaccaacatggtgaaaccctgtctctactaaaaatacaaaaattagcctggcgtggtggtgcttgcctgtaatcccagctacttgggaggtggagggaggagaatcgcttgaacccaggaggcagaggttgcagtgagctgagatcgcattactgcactccaccctgagtgaaagagtgagactctctcaaaaaaaaaaaaaataaataaataaataaataaattggatgagcatagtggcaaccaggggtgggcattcctagtggaaggttggttgtgtgagtcagatctgggttggaggggccagggagtgttggagggactcaaaggatgctatggctggaaagagagagagagagagagaaaggaaagtgtgcattatgagactagaaagctaagctaataaagactcactcttaatggggtcaggagtttcacctgtatctgaaaagcaatgggcaactattattaagggttgtaagcagtgtggcaacatcagaattactattttaaagtcatctgcttgcactttttatagcagggactacagcagggcatgagtagaagatgatccaggagagagaaggtcatgaacaggacatcatggaaggcagtgggggagatagctcctacagaaggatgcaggactttgctcagtgcttcagttatatttctggtgctgaaaaggagtagatagaatactccaacatgggcaaaatatctgcactgtatatgtggtttccgattgaagtattgaaaaatacaagatcatgcaggagctggatttaaaaaataataataagatatgaaatccagaatacctaaacaaaccaccatcaccactaccaaaaatttgtttctaagaaatgaagaagaaaaagccacttgcattagatgctagagcagaagtgggtatagaatgtagctggaaatctacttcagggttaacatatagcaaacttgttttcagttcctctgtcctgtcctattctctcacaattgtacctccatgagccatttttcctctggttcaatttcttcccctaatgcagcttctgccatctctgtcttccatgtcttcatttgcctatttttatttcttccaaatgtttacattactaacaaaaactgacatcacttactaacaaaactaacataaaagtacaacttcatggctgtgctaaatacttctattgggacaattttttagttcttacaacaactttgtgaggtaggtacttaatattctcgtttgcagataggaggagtgagtttcaggtaagccagatgacttggtcaaaggtcacacagttagtaatggcagagccagtatttaaacccaggtagcccatttaaaaaaaatcagaattagctcttgatatgagcacccttagacctacatacttgtgcttaaactttacattgaatatctatcacctacagagcttgttaaaatgcagattttgattttgtggccctggaatggggcccaagttttgcattttctttttttaaattttattttattttattttattttaatttaaggttttgcatcttctacatgctctcatgttgaaattgctggttcctggatcccactctgagtagcattagtgtatgacaggcattcagtgaatatttattgaatgaagtaattcaaataaagaaatgctaagatgtatatgtcagtgatttctttctttggatatcttgttgttgccttgcacttatggctgtctgaatagtaattattcagttgaatattgaatgatcacctgctatggatagggaagacccactgtgaaagacgcagagatgaatggatatgacctctcttctgggctggaagccttaggtgccattttcaggtgggcaaggattctggctcagcacaggctcctggacaagttgccgctcagcctgctctccctaccactagtcttcatgacatgatctaccagggccagtctctgtgctaagtgttttattaatacatgtatcatttcattagttacattcaacattcctgcactgtaggtactactgtttttcctcacttacatatgaggaaactgtggcagagagcagttaactagcttgcccagatacacaacaaggttgacatttgaatcaaagtgtttttcattatagggccccatttcttatttatttatatacttgtttgttagtttatttaaaaatattttaatttttacagattcaggggttacttgtgcaggttatttttttttacatggatatgttgtataatggtgaggtttgggcttctagtatgcccatcaactgaatagtgaacattgcacccaataggttgtttttaagctgatacttccccacatgctcccaccatttgaagtctccattgtctattatttccatctgtatgtctatgtgtacttattgtgaagttcccacttataagtgagaacaagcagtatttgattttccaaattattccacttagaaataacttagttatttcacttgaagtataatgactttcagcttcattcatgttgccgaaaaagacatgattttattctttgatatgtggagtaccatttcttaaccataattctcttctgccaatctggaatgatgagatggagaatgatgcaaaggtagaaataggaagtagcaagcatacaaatagttgtcttgtttggtcttttaaatcttgagaaatacagaaaatggaaaatttagaaaagtatatcacaaatggtgggatattcgcattgataaaggctttttgtcagtcttgttttatatttttttaatgtaaaacaaacaaaacctgacaggtaatgttcacaatccctttatgcctcccaattcacattttctctcccaccctttccagagctgtgcttgtttacttccaggtcatgtttctctatttctagaaaatatttttctgtattcttgaaagtgtttttctgtaatattatatatatgcaacacaacatatatattgtatcgtttgggtgttaaaaatatccagaagttataatatgctacgtgtaacaatctacaacatacatttttcacttggcattatgtttttgaggtctgtctgtgttgaatcatataggaatagcttttcaattttaatttctactacattccatcttatctgttctactgtcaatggatatttagcttgattataatacaatttcatgaatgctgatgtaaacattcttgagcagtcttctgagacataagtgcaagagtttctatagaatctataggtagaaatggaattgttgaattttatgttcttttaaaaattattgatatgttgacaactattctcagaaatgattgcagcaacttaattccttccggaaatgtatactgttatcaacactttgtgaagtctgatatttttctccctatttgaagagcataaattggtatccaaatgttaatttaactcgcagtactttggttgccgattcaagttatgttggtttttgtttgttggtttgtttgttggttgttggatttctattttgcctcttcacatgtttggctcattttttctaactagtttgtaacagtccttgtctgttcttaatactgtacttaatacttaatcctatttgcggttcattacaatagctatttgtattctctttgttatttgctttatactatccataagtcaatactgaacacttagaaaaattatattttttctttcgtgagacgtacttgtcacttacaaagggcttctttggggagaggaagcataaaagaatgattaggaactttgtctctgcagctaggctgcctgagatggaagctgagctgtctcccatcccatcccatcccatcccatcccatcccatcccatcccatcccatcccatcccatcctaacctctcctatccatcttatcacattgcattgatctgaccttcagtacaatgttgaacagtagaggtgattggaggaggtagggttagcagaattccttgtgaagtagcagcatggtctcgattgcgaattacagaattttttttcaggcctgtcctgtgtagcaggcatgaagataagaatagcttttgttgctggtgcttcatccttgcaaggattttagtcaaattatcatttggagggagtagtcatactgtatgtgaggacagcaggcttaggttagaaatgctgaaaactattttgggtccattcaccacgaattttctgtttaacttcatatgcattttagttgtcattttatttattgatatcccccactagactcatgaggataatgtccatgacaatattattgactgatatagttccaaagtctaaaatagtatctggcatattttaggtatatatttatcaaatgattgaattaatgatctcactttgcctctctgtccaattatatctgtaaaatgaggtcagtggaatttgccccgctcccctgaaagagttggcaaggttaaatcagataatgtgttctgaaaaaccacccaatttatgatgatcacaggtcatggtggatagcagtaatcaaggaagcacaagtaggtgacacatttgtctgtctcctccaccagaatgggaattccatgagaacacagattttctacgacttatttgttcctgtgactcatgtgtctggaatagtgcccggaatttgggtacttttggataaatggaatagagtggaatttaatcaatatctttatttgacacaaaaaataaaggacaaagcgaagttgaattcaagaatctgatgtgaaagcatatatatgagtgagagtgtatatgagaagagtggaaaagaagaaagcagaagaaaaaaatggatcggaaaaccataagtgagaatgaaggagacaatgtctaggatttttaaaaaacgctagtctgaaaaggtcaatttgatgtttggggttgtctttctaactgaataggatcgatccaacgaccagtatgattgcataaaactggtcattaagatggtaagggaaccacaatttaactgtaagtgcctgatttaggatttgtaagtcagtgaagagagatgagagacaagagtctgcagacctctgaccctatgtattctgtggaagtgctttaagacttggacagttgcctgagcttagaaaacaataataatgtatcctgaagaactttgaatttatacttgggttttgtccatcctaacattctctgtattctcataaaagtagtttcagtaggcatctgttgttttttccttgtcctgcatttattttctttgttttttttcccttgctaacagcttcccagtttgttttggggaataacttcccagtttcattcctttgatttgtgtgatgatttactgctcttccatctataggagtggccatgggacccaggccagggcaatgaacatagaccatttcttggccacaatgttttgctcaataatgttcacaaggcctgatataggcaaatacattcaatctttggacttctggtctaactgttgtgaaagagaagtcatctttcaactaggattactgcactgaccgttaaccaaagaagagaacctgaccaagagaagccaaacaaaacaaaacaaaaaaaagctaatagggagaagctaagttgtgatgataatgtttaggtatgtgaatccgttgttgcctaaagttcttctgcatgagccatttcaattgtatcggccagtaaattctctagtacatttaatttgaatggagattcacttgcagtcaaaaagcatattgattactacactttgattttttaaaacttttcaatggaattgattcttgagagcacagcccttatgcctaggctgaagaaagtcagaagtatatgtcatgccccaagtaaaacattacttctagataattttttattgaaaacacacttttgggacctttgaatcttgtcagtgtttgcacatctatagcaaggtatggttgaattagattacgtccaggtcaaaagtgtaaaattttatgacagcttttcttgcaatgatcccatgatattgcctggtattttctggcaattcctgatgaggaggttaactcttgccaagtttgagagtacaccctgccatttatcccactttcttatttcttttcatgttcatgtttcttaatgccccaataacattaaaaggcactgcagctgtgataatgatgaaaatagctattattttgaattcttacaatactaagttcttgacataagtcatttcaattaatcttcccaagaacacagtgaggcaggaattaatatgcaatatataatcatggtttcagcatgagggtcttgggattatttagattaacctcacctcacctacccctcaagtatagataggcaacttctccacttaccctaattagtgtccagagtctcattatcattttaggggcctacaggttccctgagaggttgtgtattagtgaggtgtcacttgggccaatcaggtgagatctaccaagttgttttccataaataggcataactcttgccgagtgtttgcgggtgatatactgctattttggcttccaatgaaaatcacttggaaggttcttccttttgtgatggctaagcaggtagtgatgagagtgatcatttatctccaacatgaccctttagtagatgtgaacagtgccgctccacgtgatccttccaagagtttgcaagctggctcttgcggggtaggataatcttttatctttcaaggaagttgtctctaggatcatattctaacatctcagagctttttttcttttttttcttaaagtaattcttccactttactttgatctctatgctgcccctccctctcctccttctctttctttttgcaattatttttcctcttgttctttcacggttgacaggaaggattcattaaacttataattcaaattattagcaatcaaaaatgttttaaagttgacttttttaaagtttgacttcaaaatcaaaaacctaaactttaaatgatgccaggaagtaaagggaaattcttaaaattaatcttcagaattcataaggaaaaaagaaaaaggagttaattctcctttttaaaatgttgtgaatgttcatattctaaaaccatttcaatcctcgttttacagattaggaaaccaaggctcagagaatgagtaattagtaattagtaatgagtcaaagatcacagagttaagaagctgtatgtagagcttgtagtcaagcctaggtgcgactgaatataaaaccttgctactatccatttagcccaaaggatgtgggcaagatctggtccataacgcactcttaggaaaatgatttgagaaaaatgtcataaataatggcttttagaaaaaaaaaggatacgccacaagatttgtcagttcttttctacaggttattataggaaggagccaacaaaccgtttagaagtccatgtggatttctaaacttataacctataatagtccttgacaatgaacattctctgaaattcatagtttgtagacaaacttctgggcatttgttttgctctgtgtttaaaaataacttcgatatgttctatatgtaattttactgattaaatttttacaactatatatatttataacccattcatagctttatttctcaatatttagtgagttatggttacatattttaaataatttttaaccttatatagtagctatgaatgtaatacttttattattctatacaaaatggaaactgttctttcagtataaacagttattagctgtttacatttcacatgaacatttttgaggtatgaaaagcatcttttcagtagttcttgataaaccctcctgcttcatttcttgtgtcagaatacaggaaacaaagaggtatgtatttaatatcatgaaaggatcttgtcacatccaaaatagaacagttaattctacaagtttcaacatgcacaggaataacttataaacctgataatgaaatgcatttttcactggcaatttccagtttcagtaactgaacgttgctttgcacaaagttagactctcaaaattcagagaattcctgaagccaacttgttgctgtataactgcacatttttgtatctgtagtaaattgtaacttaaaagtttctagtgttttctatggaaaattttctttcatggcttgagaattaaagtactagagtatggatatacaaatgtttcatactgaaaggtaacatagacagcatgtcagttgctgcacattggacagagtcggacatggtatgtcatttgctggactctaggtaatgttggaaatgcttcttcatgttctttatagtgacaatgaagatgttttgtttgtttggcttcagttttctttttttttttgccattttttttttggcttaaagatcatcatgaaagaccccttacagtacagtggtgatatcaaagttggaagggaaagctaatgtgaaaaatgccaaaatccaaataaaaatccaacaggatgagctcaaatgggggagagaattccattaagtgtagatgtgataacaataaaagttcagaagcacaaaatttcctagaatatcagggtaatctggattaaaatctgctcataaaggggaaaatagaggtcctagatgacaagtgctgcctatagaacacagctgcttaaacagatgatgtgacctcaactgcacgccttgagtcacttcacacaatattatcaggttatatctagaacatggactcctttcttaaggacattattgacaggtgagagaagttgaaaattctgggacggctttgtctaaggaggatctggagagactgttcagatgtggagatcatgttttctcctcctgtggcctgttgacacttcctcataaatagaataaaatacataaatggaatcccatgtaattctctctcctatttgtttgtcttcattattctctatattggtaaagagaagcaccactgttgggattaaaagagacaatgtgacacttggctatgagtttggtccatagtaagctctcaatacatggctgacagttatgattaccatatatctcttcatttaattcttctaaaaactttacgaggtaagtactactcttatctgcatatttagatgagaaaactgagggtcgcaggagttacatggttgaattagggcaaccttgtctaggcttcagagtaggagggaacctgaagtctgtctgacctcatagaaagcttatgccattaatcaataatccctactgcctctcgagactatacaatatgattggataatgacagtgaagtgagaaggggaggttataatttccacatcccttttaacttgttctgaaagccttgctactttactttgggtctttaaagcttccagtaccattcctttgtactttgaatgtcttctcaactgcagagacacacacacgcacacatacacacacagagagagaactacattagctattaaactggatacatggccatgtactattttctaactgaactttttagtacttcaaagacttgaagtacagtttaatggtgttttagctgtcactggaattaaaagtcgtgtgccattgtgtgctgagtttggtcccccctttcagctgatatttagagaagtaattattctacttgaggcttgagggatgtgtgtaccatgaaacagacaataaagacagacctcttgaggtctgccatggattatttatttccccctcatattccttactgagaacaattcacagcctacatttttgatccactataactttttccttaatagaaaggtaaaaggactttagagctaactctcccaaatttatataatcactaaatcacacagcaaaaaacaacaacaaaatctagtccttaaggttgccagcaccagggagcaaaggcagaggtggcttttgccaggcaatgattaaacacactcagagtgattgttcttcaaagagactcatactatggactgagcagaatcacagttggccagtaaggaattcatattttttcatgtcccctcctctaaccatatgaagcttagacaatgtccccctgcttcaatttgtcaagtatttattgcttatattttatcagttgaggtttgctggttgttgactccatctttcagttggtatagcatgtttgtttgctttctccctttcctcatgtgtcttctgagtatctgggactatagatgtgcatcaccatgtctggctaattaaaaaaatttttttatagagacactatgttgcccaggctggtctcaaactcctggtctcaagcaatcctcttgccttgacctcccaaagcactgggattacagggtgagctactgcacccggccgagttttctgttttctatatgattcaacataccttctgatttgaggcactcaggacataattaataaatacttattaacttaatatgcctaagaatgagccaagaaagtgatgaagccctgatttcatcccaccaataaccatggaaagctttctgaatcaaccccacttgtggcatgtgaaacaggagtagcagcagttttaagctattgtaggtcagaaatagttgctatattctaggagccctgggacagaaaggtaagaaatgggtgaagtgaacagatttacaaaaaggaaagagttgtggggcttatgggtactggaaagaccacgctgaatcaaaaagtgtccaagttcaaatctctggaaacaagcaaacagaagcacaagaaaaggtccacaaatctgtagcctgctagttaatgggctctgattatagacaaactgaggcaagttcagagcatcagggatgtcaggggttcaatgatatcttatgagatagtgctggatactttatcctatgtaagagagaactcaaattggaaggtaacattttcttcggtaatctaaaaagactgaccagggaagaataagacttagtgtccgaggtcagtatttggaattcacaagaagatagattttgcttgagttcatttgcttgagagattttgaatgaattctgatgaataatcagttcctctcactcaaggtgtttaggcttagtttggggaaattagagccagcatgttgaagagggattggatttaaggatgttcatggtcttttgccagttttgttatttcacaattacttgaaggccacggtgcagggagatattctagatgaatggatgtgtataatcatcatttaccaaacagttccttgcagatggagtagtaatcagccattgatggatatttagaacaataaatatgtcttctattattaaataaataatcactttacaatctagaagttagagaaacaattgaggtaatctgtctagtgaattagttatctatcatttgcataacaaattacccaaaaatataggggctggtatagtttgaatatatgtccctgccaaacgtcacatgaattgtaatccccgctgttggaggtggggcctagtgggagatgtttaggtcatgagagaggacccctcatggcttggtgctgtccttgtgatagtgactgagttctcatgagatgcagtcaattaaaagtgtggcaccttctaccttcccttgctactgcttttgccttgtgatgtacctgctcccaattcaccatctactttgagtaaaagctccttgaggcctctccagaagtggagcagatgctggcaccatgcttgtacaacctgcattaaaccttttttctttatagattattcagcttcagatatttctttatagcaatgtaagaacagcctaatacaggggcttcatacaacaatgttcatttattatctcatggcttttgtgagtctggaatcctagagtggcttagctgggtagttctgatgcagggtgtttcagaaggtcttgatcaagatgtcagccagggctgcagctgttggtaggcctgactgagcctggaggatctgcttccaatgcggctcactcacatgatgggcaagttggtgctgaccgcagatgagaagtcccaattcctcccggcttggccttctatagagggttgcttgaatgtccttgtagtatggcagttggctttccccagagtgtctgattcaaaagaaagaagccacacctttttttgacctcagaagtcacacttcgtttttgcaatattcagctggtttcacagaccagccctattcgctgtgggaagggaatacacaagagaataaacatcaggaagcaagaatcattgaggactgccttggacattggccaccgcatctgatcagtcctacccttgtggatttatttctcacatattcttccaagtttgaaatatcttgatcaaagagagtttctgcataattttacagttcagtgtgtgttttttttctcttgtactttttaatttgaactcattctttatataggtattttgaagaacagcttgataacgttccatcctggatctcttagtgtgcaattactgagaaaaccttttatacctaattatcaaagggcacacggattaggaagaaaaactctcagaccagatattgagcattctaatattattggtcctttgaaatttctagctaagggttaaatgttcagttcttacaacttctgctatgtaattaatatgtatataatgcatggaaattcatgttgtccttcatgagttgctgatatttaatctactgttcaagccttcaccagctctactattttctcaggaaaagggccataaaaaaggttttatcgagtccattttatcagctttttgatgggtttactaaacctaacggagaattgctgtgtcagagtgtatcactttaaaaaaaatgggcatttggatgaggtatttttgttttcctggttacattttgcagcactgtcagttgctgatttttttcccttctaccacagattgttatagtatttaacgtttatgtgttctctcttagtaacaactggggccatggccaaaattctgattgggagtgggtggtagggttggaaactatatatatgatggctgaacagctgagataatttatgtttttgaggcaataatcatgaataatgcaaatctagctattaaaatagaaggaagggatgacatcttactgggtgggaattttaaggtaaagctatagttttagagttataataatggtacctatggctaggcgtcaacattattactcactgtgcactcaatttgaggccaaaaatgtaatatatttaatttaaccctgaggaacagttggcagggaattaatctggtcgtgtttcctcggagaagtcttcctctccctggctcccctacattggatcaggtgctcctctgagtgctcccacagccccctgtatgtgtccatcattagcagttattatgactcattgacgtcttaacatatttcacaagaatgttaacttgatgaggcagaggctacatttactttagttactgttgaattcctagtactgtgcatgctgtgggcatgttagttagtaggctttcagcagcagctttcagcatttcagtagggaaatccaactgaaacaggctaaaccacaaaagataactaattactcaataccttcaaagtctctttgtacatggtttcaagcaggactggatctaaatacccaaaggtgtatgttgtctctgtctcttgaagcttttttccttagtgctagtgttaatttcagggaacttcttccttttgggtatcaacatggccaccagcaagcccctttttgaaccaccaaaaaggttatataataacaattctctgaaaatgagtctttgcagaagctccaaccacattctgccagtggcccttccagcggctactgtgttgctggttttcactatgattgtggcctgttagttttccttttttttttttcctcttcctcaaatggtttcagtgcaaatcctaggcactcaagcactttgcttcgatgagactatttggggtcacacattctcctgagccattcactgtctttggagggctagaaatacagtgattgatatgagttatctacaagggatctgccgaggacgtggaacctgaaaggttttgactgatgaccaggcttaggtaagaggagagcaggggaaggcattctggctaggtaagccaaaggaacaaagacaaagagccatggcatatggagaagttgaagaggcaagtaattggtggaaacagtatttgaaccgcagctctctgaatgagaatcacacttaacctgccatagtaccacattgctctcttataaatgctatcttgtaaaggctattttatgctattctttatactttcatatgcttaaaggaacttcaaacactggatagggttagatatctctaaaccgtctggagaaagcagaaggagttgttgtttttagcactccacatattggttgagcagattttacccacctgggtgataaagtgaggtataactataaagtggctaaagcaacaaaagaaagatgccaagtgaagcagtgtgatttctgaaaatggaagatatattaatctacaaagacagtgattttcctgaaataagtctcaaagcagaaattaactgagggtccttacacaaaggatattgaaacaaagtagtatgctattgcttaacccgtagacattcaaagatttgaatgttattggatcattggctattcatagtgtccacaaaggaggtaagtgtcagacaattcacattacaccttcattaattgtgtttcttgaaacctctcacatccatagttgctgatactctatctctcctcccaaatacacacccacataacattcatgttcaaaagccaaacatctgacctctcagacatatgaaatcttacatgatgcccaatgagtttacaaaaagcactgtgtcttgtgtctttgcactgtcatcttctctgttggaatgttaagtgcatgcaacataacactaagtagttcagaatatgatttatttttcattgccactaagatttacaaaaagccttactatgtgtcaggctgcaatgccaagcacttttcaagtgtagtctaatttaattgaccagtatttgtatagattaataatggtgtgcatagagtagaggtgatttatttagctccctccttggaattcacattaagagcaaggttattacttccttatctccctcatgaattaaaataagtggccaggacactgttgtgtgtgttcccttccccagacccatatcattcatgatctgtctgtaacagtgaacaaagtggctgtgagttgctgtcccagccagatgtttcaggccatgctcagaggcagacaaatgtgtccagtggaacagtcaccatttctacaagtgaccttgtctctggcagatcaaagtagcctcactgagcagttaggaaatgcctgaactattctccagttggggtagaggataggggctctttcttaacataatgatttaaaaagccaaccaacaaattctgttcacattttagttccaagatgtgaaaacaaatactcaaagtctctaaaccaaaatatttaggaaataaatggcaaacaaatttcctaatgtgaccaaaacctggccaaacttggaacaccgagtttccattaagtgaataatttcttatactgaaacacaagctcccatttcccaactgcctatgagacctcaggaccataaccatccctaaattgtgtcttgtttttgtgagttcattgctgtaaggtactatggcatgagttttgtcttaatgttgtcattgtagcctcaattgaaataatttccatcattctatttggtcagatgtctttctggttatgctctgtaaatgttagacctttgagtatagagagatgcttggtaatgttcatcaaacaaaagaagttaaataaagcccaaagaattaccaatctgggattcttacctagaaacataatgctccatttctatgactggcatgctccacaggaagggaaaatcacagaaaatcacttctggccagctgttgcttctgcagcatcttggctgtctctggcaggaggcaatgcttttccttccctcaggcagaaaataatttggaatttggggaagcattgaagaaaaggtcaagtctgactggaaaggacatagaaaataactggtgatgctacttttgctcttaggtattactggcttttttattctagaaagcaactataaaaaatctccaaagtttgcatagaagccttggtccttattattcaaaagctcacagtttaagctatgtcctggtaacctcaaaggtctgtaacagataacagcattcaaatttcttgggtaaggtgaaagaataagtcataagtcacttagctagtgagtaaacctagataactgcccaacatcaagatctcaatggggctttgatatctttgactctttcctatatttagtaacatttgtgaatttattaaaaaaacaacagcaactttgctttttaaagaaattgactaccagataaaggtaaatgtgggtcaaagttgaaagttgggttatcagtggggaagaccatatgagagaaaatatgtatttcttgatgtgattaaaaaggaagaagtcaacctgtattcatcagcttgagcatttgcaatggtttcattgtgtatctccttctcaatgtcaggacaaaaatgtcatttactgtgtgtgctttggtaggtgatggtctcattatgcatttccttctcagtgtcaggacacaaatgccatttaatgtgtgtgctttggtagatagttttattgtagtgtaaatatcaagatagttaaataatcaccatttagagggaacaaaaataatttaaaaatgacttacccttcaattattctcatcttctaaatactgaccaaactggacacttgcatctttacccagccctgacacgtggtattttctgggagcaaattaagggagagggaaaaaaaaaaacccaggggagaaaaagggaagagtcaatacagcacaggttgtaagccaactatgcctttagggatgaagaaagaaggacagaggtgacagcactaaaaatgatgatgtaagtgacaggtgaagccagcctgacttcctgggtcgagtggggacttggagaacttttctgtctagctaaaggtttgtaaacgcaccaatcaacactctgtaaaaacggaccaatcagcactctgtgtctagctaaatgtttgtaaatgcaccaatcagcactctgtaaaaacgaaccaatcagcacactgtaaaatggaccaatcagcgctctgtaaaatggaccaatcagcaggaagtgggcgggtccaaataagggaataaaagctggacacccacccagcagcgggaacccgcttgggtccccttccatgctgtgaaagctttgtgctttagctctttgccaataaatcttgctgctgctcactctttgggtccatgcagcctttatgagctgtaacgttcactgggaaggtctgcagcttcactcctgaagtgagcgagaccacgaacccactggaaggaaagaacaactctggatgcactgcaagagctgtaacactcactgtgaaggtctgcgacttcactcctgaagtcagcaagaccatgaacccaccagaaggaataaactccagacacatctgaacatgtgaaggaacaaactccagacacaccatctttaagaaccgaaacactcaccatgagggtccgtggcttcattcttgaagttagcaagaccaagaacccaccaattctggacacataaggagctctgaaatttctctcctccataaaaacaatgaaaaaactggcaaaaatgatcagaaccaactttctcagactttggaaattaaccaagggcttgcagtaacctagggaacatttgttctaaaaaacaagtgaatcttcataagaagagtgaacattgttgcattttaatttgctctatttctatctccctttctccagttccacagttgcattgaaaactaatagaccacaggccgggcacagtggctcacgcgtgtaatcccagcactttgggaggccgaggtgagtggatcacaaggtaaggagttcaagagccaacatggtgaaaccccatctctactgaaaatacaaaagttagctgggtatggtggcatgtgcctgtaatcccagctactcaggaggctgaggcaggaaaattgtttgcactgggatccaggaggtggaggttgcagtgagctgagatcatgccattgcactccagtctggtctacagatggagactccgtctccaaaaaaaaacagaaaagaaaactaacagaccacagtcatagtgaaaaccagcaacacagtagccactggaagggctactggcagaatagtctttcctggaaagacctcacttgcaaagctgtctttatttgacctgacttccatctcaccaagtgaagaaatctgttttcttggggacactgtcaaaaacatttagagccaaatgtttaactttgtggctgcctgatgcaatagaccacagttgggtcaaataataggctaaaccaaaaaacttaaaagaaaaagctggagaatgatagtctataaaagctttggaagactccaacatgctgttaggaatttagaaggccatgcacatgtgtaaagctgcacacaggcctaggactgtgtgaatactctggaaagacctgtgactgtcctaagctctcacctttgggtgaccttgaggttctgtgctagcaagaagtaaagactaaggtgaaattgtctactgactggctgcgtgttaaaggtatgccccaacattcatgcagagccactcaacaaagactggaacagctatcagtttcatgtgttaaagaacacatctgttcaattattagcaaccactaagctaatgagcaacatttcactgaccaagcaaaatgaagagtactgcttttacagaattagttcagaaaagttactaaataagaacatgacaacagtcagcaacaataaaccctgaggaggagaaattctggctttcagagtttccacattattttatgtaaaatgtccagtttccaacaaaaattatgagacacacaaataaataagtatggccaatactaagaaaaaatgaattgatagaaactgtccctgaggaagcccaaatgttggaataagtagtcaaagactttaaattgactattttaaatatgtcttaaaaatctaaaaggaacatgtttataaaacttaagtgtgagaacaattttgtaccagatagagactaccaagaaaggtatgaaaaatattttttaaaagctaaatagaaattctggaattgaaagtataactgaaataaaaaattcactagaagggctaaacagcaaatttggactggtaaaagaaagaatcattgaacttgaagataggtaaatggagattatccagtctgagacacagaagaaacaaggaaggaagaaaaatgaactgagctttagagacttgtggggcacacaaatgtatcaacctgcacataatgggaatcctagagggagagaagagaacaaaaggggtagattgaatatttaaagaaataatggctgacattttcaaaagctgatgaaaaaaatttctctgtatatttaagaagcacgatgaactccatgtagaatacactcaaagagattcatacctagacaaattataatcaaattgaacaaagagataatcttgaaagtaggaaaagtgaagtgactcatcacttacaagggatcaacaagtatattaactgatttctcatcagaagccatgaaggtcagagacagtaggatgatatagccaatgtattcaaagaaaaatactgcaacccaataaatccatcaaaactgtttgcaaaaataagatagaaataaagacatttcaagttaagcaaaaactgagagaataccacatacaaaaattaacacaaaatggattaaagacccaagtgtaagagctaaaactatcaaatgcttagaaggaagtacaacaaagaaaaaaatagatcaaaagacaccatcaagaaagtaaaaagataagcccccaaatggaagaaataacttgcaataatagatacacacacacacacacacacacacacacacacgtgtcagatgtatacccttgtcagatattaatgagttaagtttttatgtggtgtgatggggagttgaactttattcattagcatgtggatattcaattgtcccagcaccatttgatggaaagatgtggatttgagggaaatgatcattagtttagcaggtcactgacatgcaaacatagtcttcatgcttgatatagtttggatatacgtctccatccaaatctcctgttgaattgtaatcaacaatgttggaggtggagcctggtgggaggtattggaatcaagggagtagatccctcaagaatggcttgggccatctccttggtgataagtgagctcttgctctgagttcacacaagatctgatccattaaaagtgtaccgcacctcttgccaccactatctttttctcatgctcctatttttgccatgtaaagtgcctgcccccactttgcgttccaccataattgtaagcttcctgaggtctctttagaagccaagcagatgccagcaccatgcttcatataaagcttgcagaactgagagccaattaaacctctttacttataaatcaccctttctcagctgtttctttgtagcaacgaaagaatggcctaatgcaatgcacaatgccccaactggggaatttcccaacctgcattttacaaattggattaatgttaaacatatagccacggatgctagtttgtttgacaggatgaacagagaaataacacgtatgactatggtatttctgaaaactttgctttactcaagtatcactgaagcattttttctgtagccacttaccaactcttccctcaactttttctattaatttatctacaataaatagctaattaaaaaattttaaactctattaagcacatcataagtgttatctgtaaaatcatgagtttattgtgtttgtaatagttcctccaacaaattaatacatactcattaaaggtaaagattatccacttaattccttccaatttcttaggagcattaaggcctatgaataacgtatttggggagacattagtgtttggaaagagccttccttctgtggaaagttatttgaccagaattttagtttccaatataatgggtttgtgatctttggtgagcaagacatatctatggccttatatgtaaacagtgagcaagatatgttacctgtgttacctatcattactgagggccttctgaaagccaggatcttcctatcagacattacctaatcgggttgttcattacctcctgttgtgggtggaatggtgtctccttcaaaacatgttttaaaatcctgacccttggtatctgtaaatgtgaccttatttggaagtagtcttctccgatgtagtcaatttaagatgatacttgattagggtgtgccctaaatccaaccactagtgtctttataagatgaggaagatttggacacacagacgccctgggagagtgccacatgacaatggaggaatagattgagtgaggtgtctataaaccaatgaatactcaggattgctggcaaccacctgaagctaggagaggcaatgaaggatccttccccagagcctttagagggagtgtggctctgtggacacattgatttcagacttctagccaccagaagataaatctctgttgttttaagccacccagttagtagtaatttgttgcagagccctagggaaataatacacctaccttttcttgtctatgtcagctagatgagggcagggatcgctcatttattttgttcactgctgatcctcagatcctggaacagtttctcacacactgtaaatgcttaattcatattttttgagtgaatgcattaataaggtctcttaacagttctgagagttatacacgttgtattatgaagaaaacaagcctgggagagtttgtaaaacatattcaaggttatacagaattctagatacatctaatttcaaaatctctgctcctttcactgtactctgcccactgcaaaataaagaactggaacaaaatggtttcttgtcccttgcagctgagagcaatggttctttgataacacacatgctttttcgagatggcatattgagccatcacttccaaaaatatttgttgaggttgtagcaagactgggaccccccaatagagcaaagtaatgctaacgttttaattttttattcaataaatattgagtgagcacttactatgtaccaggtcccttaagtactttacttgatgaatcactttatatgcttttcacaatagtcttaccaagctgaaattattatttccattttacatatgaagaaactgatgcaaagagaagtcacacagcctgctgaatgtcacagctaggaaggagccaaacccacattcagtccagaccttgaaactacaaatctcaattacctgaaatgcttgtaccctcccttacatgttccaccctgtcttcaggttctggttcagcatcttacagcccggggagccctcctttcatactgtacaccttgtggtatattcctcaagcattccaccctcctgcacttctttccaccttggtagatatctggcccacctcctgaactacattcctagcctccgaagcttacaaacaacagatataacatgccttaagttggtaatataaatggtgccaaagaagctgcttcatggatgcctgagacaaattttccaggatgatcgcattctgaactagttgaaaccacaatcatattgccatcaatcttcttgaagtatttaatcacttgcacggaatctcttggggatgcttgctaaaaatatactttcctgggcttcacttgaaacttacagaatcaaaacacctgaaggtgggatcttcccaacatcagcatatatggtgtttccaggatctgcagtgtatactccctgtttaatgatttcactggaaaaatttcccattgcgtttcaggttttacctatatgtctcagcctctaagaatatttcttttcacccgaggctacagaccctcacctgtagtaagtaagtgcttctctgtgttcccgttgagcactttggtatttagccccattatagtaatttgcatactcttatatacttgcatctttacttataagtctccctttcacttacctgtgagctccttagggtcagagtctttcccagtcatatcccatgtgcttatcatagtccttgacaggtagcaggtggtcaatagtaaaatacaggaatacacaaacaaaaaaagatagtggaattaatgagcaattaggagcactgaatttctactcaaatttctgccaagagcacacagggacagaatacatccattttatttagtgttagcgtggagatcacatctttcccccacaactggccattttctcagttgcaagaggtagaattaattgtcatagagaagcagaaggaaaccatgagtgctgatgggattgtttgtcctactcatctagtttgagaaggatgcaaatgcagaaaatttagatgtttatgggacaacagcctccgccttctaaacagttcctggatacgtttggcatgacttctgttggaatgcatgaagaaagtaggaatgacaaccacataattttgcaaatcacagtatttcaaacaaaacacacccttttggcaatctaggataactacaaattaagggagccagtatctctcttcttttaaagtctaggatggggctgggtgcggtggttcacacctgtaaccccagcactttgggaggcctaggtgggcagatgaccggaggtcgggagttcaagacaagcctggccaaaatggtgaaaccgcatctttactaaaaatccacaaattagccggtcacggtggctgtcacctgtaatcccagctactcggcaggctgaggcagagaattgcttgaacacgggaggcagaggttgcagtgagctgagatcatgacactccactccagcttggatgacagagtaagactctgtctcaaaaaaaataaacaaacaaacaaataaataaaatctaggatgtttttatttcctgatagcatctagtaggtgctgcatttattatgtaggcacttaataaatgcttatgaattggacttatcttgctagtggcctccctaccaatgcatgtgggaaaggaaaaaatgcctttgaaatttctttcctttgtggtccacttatttatacaaacctgccatatgtttatgcaagcaatgtactggtggctggtagaaagaattttagaataggatagaaaatatttttaggctttggtcttgggtttgtccctaactagcccagtggcctcagataagacacttaatttctctacttttttaatgtccttacttgccagagaaggatcattttagcccccttgttagcttatatttttgatagaaggcgttaaggcaatgtgctagtgagaatttaacttgtatgaaatacatagtcacttagtaattatcaagaataaaaaaataagtaaatgcaacaataagtatgaaggagctttagtgatacagagctacccaggaatatgaagacttccaaaagcccagaaactttcaaagaaaattatttcagaaggatttaggcttcttcacacctaggcaagaatcagttaatctgatcatttgaggacaggtctatgtcaaagtatttcctgttggaaaaggaccataggctggatacattttgataggaggaaaaacagtaaggacttgctataggaaggaatgattggatatgggtccatgcattgccccagcttgggatctgaggcaacttaacaatacgtggtgatagggagggagagtagaggaaactaagctgaaaattcagccctttctgctaccgatgaggttttcctaattctgtttttcctaagagagagagagagagagagagagtgtgtgtgtgtgtgtgtgtgtgtgtgtgtgtagttctttgcatttggcatcgggggtagaatcaatggtgtgctagttcatgtttaacaatcaattcttcagaaaaaaaaaggcaaccttgattttcatgatataaatacactgccatggctgatttgaagctgtcagtgctttaacaacaggctcataaaatttcttaaagtttgacagtcagttctttgagccagtgtgagccaactccagcaaaacactgaataggttaactatgaagtaataaaaactgattatgggagacttcaaagagtaaagagaactgtctaacagatccccatattcccattacctagcttcagtaattgtcaaaccaagtaaaattcctttctctgtaccttacctgctccttccatccccagctggattattttgaagcctgtatctcaatatgtgtctctaaaagataaggactctttaaaaatgtaatacaattactgtatcaaatatattaacaacaattcctgaaaaccataagtatctagtcagtgttcaaatttctctgaatccatatatatgtattatatttatttatttatttattcctttgaggaatgcacacttggtttattcaaatcaggagccaagcaaagtcaatacactgcctttaattgatatatctcttaattctctttaaatctgtaagcttcttcttcccttccccaccacttttattttctttgcaatttgtttgttgggaaaacaaggtcacttatcttgtggttttcactgaaatttgctgatggtacttccatggtgttaatgtgttctcctgtcccctgtttttttctatataggggtaattagatctaaaggctcgatccaatttaggttctctctctctctctctgtttcttgtgtgtgtgtgtgtgtgtgtgtgtgtgggggggggggggggtgtgtctgcatgaacaagggtccttcatagggaagcgtaaaactttcttatttcctcatattaggagacacattgtgcctggttgttcatcttttagtgatatcaagatcgatcagtgggttcagtctgaaacagactacactcacattgccaaaaaaaaactacccaaaatctgagataaatattttctttttcagtctcgaagatgccttttaaccacaaacacataaatcaatatatccgtataaacagttactaaatcaacccatctattttattcatgatcacttcacatttgaaagctcttgctgtatttatttatttttttgaactgaatttggggctttgactaggaagccataaatctagtttttgatgaaatacgacttcaccacaatgccagattggaaagagttccctgccaatttttcttcttcacattgctttggtaagtggtgagtattcacattccctctgttcagggctaatgcaccgctgatttagcttcaacctcctcaaaagttttttctttaactgttaatttttgatggacaatgtattaccagggacagtcacatctgccaggttgtgcaggcaggatttgaagcgtgcctaaggtgtgggcagatgaacaagttctatcacctggagtgtggcggtttccctaactctccctagccactagttaggccttaatatgcttagaaggttgctcgtctaatatgaactgtgtgagactttggctggagggtagttctgtgtcccagtgataaaagaacacgtaaaacaacccagtgcctgatcattctccctggctgtcagtgaatcatgtctaatggcatctctatacagtttgcgccaatttgcttgcaatggcatccttttccgtgggctcgctgctcagcaggccctgaagcaatctatgaataacttcccaacagatgctgtttatgaattgaagcaaatggcttccctgtttctcttttttctcacttcaataattttcagttacattacgatgaatatttatagtcctgtagcagtgcataaaaatggagaacaagcagacctgggcattgtttcatacgtgagtgctgttctaatgggttttggctgactggttttaataatgttcagttgatggactgaaagaggatgcaaatcgtagatcagtcattttcatgcactgttttagcaggatgggcattgatggagcgctggttgcatccctcacgtgcctgtgatgccttaactctctaagtcaactcgttcctatgtgtctgcctcctctgtctacttcttttgagtaatatcaactagttgacttccgcagagactctgacaccaatgtaagagctcattaggtttattttaccactctctacaggtattaccatttgtgattcaaacgactaactgtgttagaagctgcggcccaaccaacataacattctgtgaaatgaaaatgtaaaatcataaggaatacgttggttttgatttgccagcttattttatagaaagatattgagccacattttactctaaatggctttttcaaatgttccatatttccatgttctcttaaatattacaaaaatgagaggacttacatctaaacatcgctcctaaatttgattccaagagagctactctaacttcagtggcttatgtttcaaatagctgatataccttacttgcattttctattttacaataatgagttagttaactagcctatattttccaaaccattgactgtgtcatatgggcccacatacaaataattgtctgtttggctatttgcttataaataagagtgttgaaaattgtatgtaaatatgtatatgcatgcacagtaaatatatattgaagcctcccaaaatattcaaattgcctcattttccactgttgcattatgaaatactcaccaactactcaaatggaaccatatttattatgcatgcaaacccacaatatctttaccacctatcatttgtatgctgtacacagaaggttgtgctgtaacacaacagtaaaaaataaaaacggcaatttggagagaaggatctttcttgctctaactgcagcagatgcaaagagtggtttcctttgaaaaggggaagtataacacaatcctgaaatatttgaagcattaacaaaaagttcaagaatttaatatttgatatgcaaatattattgttaaagaaactaatatgcagcataatgtctcagaatgcttcaaaatcatgcccccaaaatactaaactaagaaactctgagaatattttcaggcctggagcaaaaggtctaaaaatagaccaggatttgtacttttgcagaacaattcaccatagcacttttctatttgtcttaaataatagtaaaatattgtaaatgttacaaatgtaataaacagtatgggaagttaattgttcccctcactaggaaaactaccgttaataatgctttgtatataactttagatagtagtacgcatatggaacatttacacaggaatatttttcttcatgtgccatattttctcttccataatggaaagtgtctggatcttgtgttctttttgcactttttatttttttattttttgagacagagttttgctcttgtcacacaggctagagtgcaacggcacaatcttggctcactgcaactctgcctcccaggttcaagcgattctcccgccagagcctcccgagtagctgggattacaggtgccccccactacacagggttactttttgtatttttggtagagatgtggtttcaccatgttggccagactggcctcgaagtcctgaccttaagacctcaagtgagctactcgccttggtctcccaaagttctgggattacgggcgtgagccaccgcgaccagccgtctttttgcaccttgttcttgatcaacacttctcctgatttctaagtaggcaagcttttttattgtttattgttttgttttcttttatattattccttcaccctagagttactttgagtttcattttaagtatgatttttaaaaagccatggggaaaattgtcacttgctgatgggtttttctgtagtggccacagtatcagggagtgagtccacttctcaatacaagggtgctgcaaaaacattatttgggtatgcagaattgtgtgtgagatctaggcatcaggaagtaattctgttataataaataggtggataaataagaggatgaggagggtactagatacaaacataagcctaagttgggggctaagatagtgcccagcagaaaactatcaggaatactacatcagaaccatgcttcaagacagggggtttaggtcacagagaagatgtagtttggcctgttgtttgtttaccttgaagctaaaactgcctgaaaaattaaggaagataaattgagactagttcaaaaatcaagacaattatctcatataaatttcttaaaagcccctttgtaaacaatttcatttcacaaatcaggaaacaggcctagagtgttccaaggtgacactgttctgctaggcttgaacctaggtctatgtgacacaaatggccatactcttgaccggcatgcttcatcagcctgtcacatgaaccccttcgatgctaaaggtgggaagaggctactgataaagcaagccacaggtagcatgcaccagattaatgagatgttcctgattcacctaatcacatcaactaatcttccagcactaaaaccaaccactaacttaccataataattttcacatggtttgattcatgagaacttgagaggggcctaggatttataataagccctggcaggagattctaaaccatatgtggagaaatggcgtgttagtccatgttacttttttatttggtataaatataaattcaaatgttttcagaaaacataaactaaaaattctttattggaagaatcagttagactttgtaaaacattcatgcaaattggcaactatagatcctcaattattttagattacatgtaaaccttaaattattttactcccacaacccaataactgaggttagatgtagttaaaaatgattgttgcccccatcatcataacagcatgcattgttaaaaagtatattttaaagagcacagaaagtaactactgacaatttctcatggaaattacttttttttgtccctggacaaagagttcagggctaatcaaaaaccaatcaatataaactctaatgtaaaccataattaaggatgacaaataggttcttgtatgatgttaaacaatgcatttataaagataacaatccaaagtaaaaatttaaaaaccaaaccaccaaagtatagaggatgcatgctggtgactttttctttgtcactcactccaaatcttcatgtaaccataaagttacctgcaactgagtataaatgccttaagaggtgccaatacttagagtgtgagtcctgtgatattttaaaaggtattttaggttttcatgtaccgatgattcattttagccaactcttgatactcagttgctgtgtttgataaggtcatttggttctgagattctcctatgggatgggcagggagacccctgatgtgcatggttcttagaacttggaagactggtagatgtctctaatgcattatcaaaagggctgaagtcagcacctgtaagaattcaagcacagcaagaatgcagatgctgtccatttcaaagcaagcatttataggaaaaaacccaggcaatagagtcttggaataattttggtaaacacatttaacaggaaggcctcatctgagaagcaaacaggactgtcatgctgtacacccttagggggcaccaattccattgtgcaccaacaaacatcgcactggaaagtaattattctcatagtatactatatggaaaatgaatgtaaattgccagtctattcccattttatagagctgtcatgaaggtcaatttgtttgcaaagaggctgagcatttgggagaaatgcatacatttattacacatttgtattaggtagtttatatttaaataggaaccatgtactagaagtaaaacaacccctctaaactttcggtatttctgatgattatttaatattttatacttttaatgtgctgtcagattaataaagtatggataaaaggcactgtacaaagttataggtgatattattaaataacactaatttaagctgatgactagagattgcactacttaaatttctatttcgagtcaccagctgtttattttgtattttcctgtttgaaggtgattttcaaagggatcttcatgctgaatggaggcacacacacagaaacaattgtctttaaaatgcagtccatatcatatctgcatgtctgacttggactttgtccatataaatggcttttgggctatgggctctttgttttcagtagatgtatagggagactgaagacatttgtgagtcaggcatcctaaacacaaggcatgactgtgccaaaatgataaccacctggcaaaattcacgttgttgggaatgaggctaaaagtacctgtttctctccactgcctagagagttaagttggaggatcatttgatgtgtctagttctttgcagtctatcctaaggttaagattaccttgttctttgcatcacttagattggcaaaaagttctggttaaaacttgtgatttaaattgtggactgccttgggtatactggtatgcttttcatggacttagtaggtaggtctggaaaaacttgacaaaatgtatcaccatctaggattctttggttttcgttttctcttttactgtatatgcagaaataatttgatgtagtgaacttgctaactaaattctattttttccagctataatcaagcagatactaagaaccatttactaaggatctgtgatgagcagtgttctgccctagcagtttaaacatattttcttatttatattatgcaagaactttataagactaatgtttttccccttttagagataaataaactgaggctcagaatgattaatttattcaaggccaaaaatctaatatttaatccaggtatgttgggcctttttttattttttattttttttattatcattatactttaagttttagggtacatgtgcacaatgtgcaggttagttacatatgtatacatgtgccatgctggtgcgctgcacccactaacttgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctaaaaaggacatgaactcatcattttttatggctgcatagtattctatggtgtatatgtgccacattttcttaatccagtctatcattgttggacatttgggttggttccaagtctttgctattatgaataatgctgcaataaacatacgtttgcatgtgtctttatagcagcatgatttatagtcctttgggtgtatacccagtaatgggatggctgggtcaaatggtatttctagttcgagatccctgaggaaacgccacactgacttccacaatggttgaactagtttacagtcccaccaacagtgtaaaagtgttcctatttctccacatcctctccagcacctgttgtttcctgactttttaatgattgccattctcactggtgtgaaatggtatctcattatggttttgatttgcatttctctgatggccagtgatgatgagcattttttcacgtgttttttggctgcataaatgtcttcttttgagaagtgtctgttcatgtcctttgcccactttttgatggggttgtttgtttttttcttgtaaatttgtttgagttcactgtagattctgaatattagccctttgtcagatgagtaggttgcgaaaattttcttccattttataggttgcctgttcactctgatggtagtttcttttgctgtgcagaagctctttagtttaattagatcccaatggtcaattttggcttttgttgccattgcttttggtgttttagacatgaagtccttgcccatgcctatgtcctgaatggtaatgcctaagttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttgtttttctcaggttagtcaaagatcagatagttgtagatatgcggcattatttctgagggctctgttctgttccattgatctatatgtctgttttggtaccagtaccatgctgttttggttactgtagccttgtagtatagtttgaagtcaggtagtgtgatgcctccggctttgttcttttggctcaggattgacttggcgatgtgggctcttttttggttccacatgaactttaaagtagttttttccaattctgtgaagaaagtcattggtagcttgatggggatggcattgaatctgtaaattaccttgggcagtatggctattttcatgatattgattcttcctaaccatgagcatggaatgtttttccatttgtttgtatcctctttcatttccttgagcagtggtttgtagttctccttgaagaggtccttcacatcccttgtaaggtggattcctgggtattttattctctttgaagcagttgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaatttccaacattatgttgaataggaatagtgagagagggcatccctgtcttgtgccagttttcaaagggaatgcttccagtttttgcccattcagtatgatattggctgtgggtttgtcatagatagctcttattattttgagatacgtcccatcaatacataatttattgagagtttttagcatgaagtgttgttgatttttgtcaaaggccttttctgcgtctattgagataatcatgtggtttttgtctttggttctgtttaaatgctggattacatgtattgatttgcatatattgaaccagccttgcatcccagggatgaagcccacttgatcatggtggataagctttttgatgtgctgctggattcgttttgccgtattttattgaggatttttgcatcaatgttcatcaaggatattggcctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggggcctttttataacctatgactccttcctgccatgtgatttcatgaatatgggtacatttttaccatctgtgtaataagagagtaacagtaaattacttccaatgcttcttgcaacattttattaatactatcttgattccattaattcaatattttgtatagaacataattcagtgtaatgagcatcttttttatctttatccaagatatgcattaataaattactaagcccgtattggaatctattatggaagaacttttgcctatcggttaagctttctcatggtaaaaacctgaaaaccagcattatcgaatgtttttgtatacgaccttccttccagatgtcaaacaaaacagtcctttcaaatatgcaaacagtataagcagatgcattgattataaggctttgagtgcttatatttttttctaggaattatcaggacaggattttattttaaaggtggtgacagcgtgtggtttgtggtgaactttcagcatccgctacaaatttatttttaaatcacaactgttgcatctctagggcctaccctgggaacataaaaaggaaaaaaaaaaaaagcctagagccctttcttaactcaattaagaacaccacaagtgataactgcattttcctatgttttctcccagcatgagctgactcagccagaaatagcacgatagtatcgcagatgttcctttgctcggattgctggttattgcttatctcaatgatattttaatacaaacacacaactgttcaccctgttttatggctgtcagaattttgcttcatatttaacaaatggaagtttatgagcagatgtatcattgactcagatttacttttcccctcattaagttgcatggaaaagctaaatgctgaattgaagagggcatcagacacatctgcagtagtagactattggagtcagatcgttcatctggactgtcattgcccaccagctcaatagacctgtgagcttcatcctctattgttaagaccaaaagatcaacatttcattctaggatcccaggcaaatatttcctctatttttgccagtgacatatgtttaatatcactactttctcctggaaataataaaacagtttcctgaaccatcatcatcttcaaatgattttttttttctgacctagctcagtgtactgagcaaggctgaagaaccaggtgcacatggcattgagttttgactctctgtggatttagctatacaaccttggtggattcatgtatattttgatctggtccctttctgctctccagcctcctcttgagctaccatttaacctcatctcagtaacactgacttttcagtttctttcttgaaacaagttgcaggatttgcctttgagtgggcgaagcctcagaacactagggggttgatacacctggggcattcaccttgagtggcactcagcaaggtgccgggattgccttccacctggtagaaagtcagactccaaaacctttgagatgaggcagaaggttatttaaaaataactgagactggcaaagtctctttccgatgacctgctgcaattcttactccaataacagtatgatcagcagctaggaaacttcgtgggagtagtttagccccctgaaatttatagctctgattgaatgttcaggagtccgtttccaagcccaaaatccaatgtgcagtctttcacatccaaccataggcaatcacatacaaggctttgcctggaagtcttcatggggaagctgctcaacctacaccatacttggtgcacaggcagtgcattgaagttttcaggagggaactgcagtcaaggactcaagctcactgggccagccatgctctttggcacagctgctttccttgcccaggcaacctggctggtacctccttatcaggggctatggctgaggcatttttctccactttgattttgtaccttttctcctcttttagacctttttccttctcttgtctccctactctgcccccaacatgagctcataaagaggcaggtgctccttggcaatgtgatgattcccccatctgcagtgcatccacttgaccctcgcccagcacttttctgtggggaaaagtgacacactgtggggctggcacctctcatgaactgcttacttgcactgtcagggtgagtgaataatggcatgattgttcctgtcactttggcttattgttctaattgactactttgacaactgattgctccaaagctattccactgtgtttcctttttggtgtgctttcataataatagtaaggaaagcaaaaacttactgatcactgtgtactaggcactgttttaaatattttgtaaaaattaactcaaaaaattctaaggtaagtactccattctattcccattttgtaactgagataactgaggcagtgagaggctttttaacttgcttgatattgtacagatatgtgggaaaatgaggatttgaaactgtgcccgctaggatataggacttctcttttacttcccttaaaaaaccttgtttcctttgctgtgacttctgacatattctcatcagccatttgactgtgtcgatataaaatcagcatggtatcatttttcttctcaggtcttttgcacataaaattcactcatgcatttatttgtcctgctaccttctattcatcaataagatttcaggtgaaagatcattttctcagagaaactttccttgaactctctctgcatttattcttatgacatcctatacctcttctatgagcacttaaccctgattgtgatcaaataattatttgttaaatagactctcctactaatattccgtgcgggtaaagattctagttatgtgtctccagtgaagtgaaatactcatcactgagcttaatgcaagaattgtaggtgaataaatcaattggtgtctacgtttcctcatccatagagaaggaacaaaaacatatatcttacagacattttgtaaagatgaattataataattctaatagcatgtagcacaaagcttagcatatagtaattgttcaataaataatagttattgctagatatggtagaaacagtattgttcttcacaatgttttcttctcctcccctcccatccctctctccatgggaagatcatacattcctgaccctttgatgttaggctacatcatgtgacttgatttggcaagtgaaaaacaagtagaaatgatatgtgttgctttcaagtagaaaccttaaaagtcattgagtcattgagtgattagtcaatgctcccttttccctctaccatgagactttccctaggccagcaaatctccagacatgagctgctctttcacagatcaggcacacatgaggtgatgtttagcccaacttcagttgatagatgtgaagtgtgatccagaaataaaacttaattgttgcaagtcaatgagattttgaggctgtttttacacaatagtaaaaattaaactaagcttactgatatattagcccaataggttaatgtgcacgcagcaattcttttggaagagtaatttattttattttattattttatatatatatttattttttagacagagtctcgctctgtcacccaggctggagttcagtggcgcgatctcagctcactgcaacctccgcctcctgggttcaagcaattctcctgcctcagcctcctgagcagttgggactacagggacctgccaccacgcccggctaattttttgtatttttagtggagatggggtttcaccgtgttatccaggatggtctcgatctcctgacctcatgatccatccgcctctgcctcccaaagtgctgggattataggcatgagccaccgcgcccggcctttggaagagtaatttctattttattttattgtggtaaaaacatggaagtcattttttaagggcattttctttcagtatcaagtgttttcttaaacatttgagaaacacacctaaatgtatgtacaaaataaaaataatagctagcaattatcaagcatttagtatatgttaaggatgtttacaagtgctttgcaaatgttaaagtatttaatcctctaaaaccttgtgaggttggttctgctatgatatccttttcacagatgtggaaaatgaggcacagagcagctaaatttatttttccaaggccagacaagtagtaagtgacagagcctgaatttgagcccaagtgttgagttcagagcctgcaattaaccgccatgcttcattatgtcatatgtaaaatgcttcattatgtcatatgtacaaatgtgcagacacaggtcgaaacacaaatatgcgtgaagtgctaagaagaatatatatttaagtacagttggcccctgaacaacacgagtttgagctgcttggatctacttacatgcaattttttttagtatttatattggaaaatattttggagccttgcaacaatttgaaaaaacttgcagccgaaccccatagactagaaggaataaaaattagaaaaaagttaagtatgtcatgagagtataaaatatgtgtagatactagtctattttattctttactaacataaaatatacacaaatttattataaaaagttaaaatgtatcagaacgtacccacacaaacacagactgaatatggagctatttgcagtcaagagaaatgtaaacaaagttaaagacctgtgttaaagcctaactgcaaaaattaactgtagtacatactgttctactgtaatcatttcatagccacctcctgttgctattgtagtgagctcaagtgttgcgagtatccacttaaaacgctgtgtgatactgatcatctctatgtgggcagttcacctccccagtaaattgcatattgcagtaaaacgtgatctctcatagttctcatgtatttttcgtggtgtttagtgcaataccataagcctcaaataacaccatagaacccatctagtgatgctggaagtgctcccaagaaacagaaaaaaagtcatgacattacaaggaaacgttgagttgcttgatatgtacctgattgaggtctgcagctttgtttgcccaccattttagacagacaattgaccttgaaaacagaaaacataaacttatggtgtcaatcataattaagaaaattatgaggaagagaaaatacactgcagtgttataaatgtgttttctcttcctcttaattttcttaataactttttcttttctctagcttactttaagaatacagtatataatacatatacaaaatatgtattaattgactgtacattatcagtaagacttttgatcaacagtaggttattagcagttaagtttttgggtagtcaaaagttaaactcaaattttcaactgtgcagggagtcagcacccttaaaccccatattgtttaacgatcaactgtacatatttaatattaccatacagaaaataaaaggatggactgtattgagattcttcccagatctcacattctgtcatttaattttatttttgttttcccatgagtatgactcagccaggaaaaagatcagtcctgctcattgaaatctcgcaattgctgacctacaagagagggtgggaccatggttcaaattcacagatccttgaaaagcatatccttatgcacaatagcaaagacttggaaccaacccaaatgtccaacaatgatagactggattaagcaaatgtggcacatatacaccatggaatactatgcagccataaaaatgatgagttcatgtcctttgtagggacatggatgaagctgggagtttgcttttaaagggattattcagtgctccccttcatttactgatttaacaaggattctacagtaatgtccaaacaaccattcccaagttggatagatggtccaatcttaagggtcgaccccctactgaaatttctgagttctttataataacatagaaaatatacgcttttgttttgatgaaattgtcaaaaataaatataaacacagtttgaattaattgggaggtgaatggaaatttgataaaagccaaaatgttagtgttgttggaagcaattagttttgagtcagccagacctggtttcaaattgcagctctgcctctgtgtgaattggaaccatgttgtttgcggtccctaagtttcagattccttatctaccaattgaaatgataaattcctaaatcattgggttgctgtgaaaactgaatttaatgttatcttcaactagcatataataaatgtcctataaattaataaagtagctattctttataattaattattaattataattaattattaattaaagaacaaattccttaaaagaatcattttacattgtaatatactggataggaacttatttacccaggtatctctcaaaggacttcctcagggattgataataacatgaatgttactgcacaaaaactggctcccttttaaagatgttaggtttggcaaactggaaaagctcggcttacccaaactatgattccacactgtttccgagcagggcgtacataagtggacattccaaggaagaaactattttagcacaacaacaaaaacaggtaaagcagaggcaataaaatagagcaaaacaaatagattttataaatagaaagtgaaaaccaaacaactgtggcaattacagctttcatatgatttatgtctttaatttgtctaaatcagtgacccatggagtattggcataaaaatttcaaattcagcaaaaacctaaatcactataaagaaacactgaatttttattagttatccttctttcattgacttctcccaaacaaaatgaattcttccctgagtgaggcaaaatgaagtattatattttactaaggtattattgatctgcaattcttaggatccaatatgtcacagaaacatagcaacagaacttacccatgaaattgacagtacagaatcactgcccaaaggccttttgccccttgcttctgtttaacactaacactaggtatcggttaagattatttagtagaaactaacagaaatggactctggctaactcgggtaaaaacaaacagacaaaaaaaccaaaaagcttcttgggaagataagatatagctcaaagagtcaggagactagataagtatccaggcttcagaaaggacagaaatcaggaccatctccatgtaaagaaaagacgtatggtttcacacaggcagcgatgccagggatctagaaggtataaataaatgaccagtcatttcaagttcttgcagatgagtgaaataactctggtggattccaaccttaaattacagccctcaaaattcaaatacttgggcaaaattgtttgactggccttcattggccagaggagggaaaggcaccttgacatacagtgtaacgatgaaggcatggtgttccccacattgaggaaccccaccagcctccagaaatgatcaaagtcctgtcaattaaaatgttactttcagtcctgtgatactcatgttgggctaaactacagagccatgcggtaagaaatctgcgttgttttaagcctggtaatatgttacagcaacaacagaacattaatacaactactttttttagtataaatatgtctcaagtattgcatgtgacacatgatattttaaaatatgatagttgctctgtaccctcttatcctaaaatgagaagctaagtcaccaaagcaatacatgctaagagatggcaaagctggttggccaggttctgagaatacccaccgctggcaattaaggtgggaggaagatatgaggaaatgcatggtgtggtatatccctttgttttcacaccttccctcatggaggaggggagagctgtgtgtgcaacctaagcccaactttaagtgatgcaaggaaaacactagtggagataaatgcctattcgttctggtttaggcctatggtggtaaagcaaagaggacgacactctacggacagattatttttttctttcttctctcttccctcttcctcttcctctcctcctcctcctcccctcctccttcccttttcccctccttttcctccttcttctactcatcttcctcctccttctccttctccttctcttcttcttgatggagtcttgctcttttgcccagactggagagaagtgatgcaatcagcctcaaactcctggactcaggtgatcctcccacctcagccgcccaagtagctagaactaaaggcatatgccaccacaccttgctaatttttaatttttttgtagaaatccagtctcacaatttttcccaggctggtcttaaactcctgagctcgagtaatccccatgccttggcctcccaaagtgctgggattataggcatgggccacaatgcctggcgtcagatgcttcttggctttacatcctaataagcccattgtaagttgaaactattctaagttgaaaatgcatttaatattcctaacctaccaaacatcatagctgagcctagcctaaaatgttctcagatcacttacattagcctgtggttggacaaaatcatttagcacaaagcctattttataataatgttgattgttgcatgtgatttattgaatattgtactacaaatgaaaaacagaatggttttgtgggtacttaaagtacagttacaccattataaagttgaaaaatcatagccaagccatagcgagttgggaccatctgtgcttatctccatattaaggaaagatgtatggttttgcagaggcagtgtgaaagagtttccacccagagagcttccggtggggggcaagtgacccaggagagtgttggagagtaggaattccagggataagacggggggcaggaagcataccaaaggtgttgctagtgtcataggagctgtggtcagaaggcccccatgggagggtgtcctaggaaacactgaagagcccccacgtgtaggaatctgcatttgtattcctgccaccctccagaaggctcagctcctaagccatgacttccttctggattagagtcttcaggcctcagaaacagagctggtgaagaagctgtgtgtattaatcagggttctctagagggacaggattaatagaatagatgtatatatgaaagggagtttattaggagaattgactcacacaatcacaaggtgaagtcccacaataggccatctacaagctgaggagcaagtaagtcagtccaagtcccaaaacctcaaaagtagggaagtgcagctttcagtctgtggccaaaggcctgagagcctctggcaaaccactgatgtaggtccaaaagtacaaaagctgaagaacttggagtttgatatttgagggcaggaagcatccaatacaggagaaagataggagtccagaagactcagccagtctagcctttctatgttccttggcctctttttatcctagccatgctgacagctgattatatggtgcccacccagattgagggtgggtctgcctctcctagtccactgactcaaatgttaatctcctttggcaacacccttacagacatacccaggaacaatattttgcatctttcaatccaatcaagttgacacccaatattaaccatcacagtgtggacggatgggacagggcaaaaaaagaagcaaccacacctcctgccctcactgaaaacttcccctcttgaggtgaatttgaactaggaaaggagaacaatttaaaatttagagtcgtaatatactttaaagtggactttgtagttactgaaatgagattgttcttgtgacttgaaagggaccagagaagctttgggtgttatctcacttttcatgtaagaacaaaaaagattaacacaaagtacgggttggaggagatggggaggaagcataccaacttttttcatgatgtgtcctgttgagtccagcatttctcatgtattagctataaaaacaacagagtgatttgtagactcaaggaaacagatcagtaagtagaaatatcaagtaagagaataaacattgaacgtttaattattgacatagaagggagactatacataattacagtgaatccagatgagattaaaacagtaagaatgctaatagataaataagactaaaacaagcagcttaataataaatggtgtctctaaggtggatattcctcccaaagcaaaaaataaaaataaaaaaagggcactcagagatataacacaaaataatttccctgaaatgaagagaaaatcacatctgcagatccaggagcacacactgattcagcacatcccatccttgaggtttccaggcagaaaaagcaaattatttacctgggagaagaaatccggatggcctcagacttttccatgttgacatccaaggccagaagacagaaagtctgcagtgcttgagggagagagagcaccacccaatgaccagagttgcttttatttctaatggttacagagcaacattgtcaaacatgaaataaatcaggaaatgtagagcctgtgagctcttgctggggggaaactctcctgaaaactaaagccagccaatggagagaccaatcagagtaagaatccaggaatgacaaatccaggaatgagaaacagtctggtggggagcactgactgtgtttaaatataatatgatattttgacaggtgtaggaaagtaacttagtcaacagccatcctaccctccatttatagtgcaaggttgtgaaagcaaaactttcatttctcagcacctcttaatttagattgtgccaaccagatgctctctagacaaaggttctgaatgcggaaataaagtgtaggcatgctgtcttgacttctgcgttttctgctgcaggcacccaaggggaagccttgagttttccgttgccgttctccaatcgtgaattgtggtatcaagttagttctctttcctgccaaggtggatctaagaagcagggtgtagctctgaaacccatagttggatggcaatggttttctgatacctgtgttagtccctagagttgaccattctattgtcgtttgccaagatgtggaccttcttgatggtgacagtggtaataactctcattttggacccattctttcatattcaaaatggagtttctcagcctaagtattgttgacattttgggtcaaataattctgttgtgagggctatcctgtacaaagtaggatgttgatcatctacatgtcagatgtctatagcacccgccctcctcccaagttgtgacaatcaaaaatgtcttcagacattacttaatgtcccctagggaccaaatgcctcctgttgagaacctctgctctgtaatcataaagcctgcttctacaactcttgcaatcctcctgttcagttttgtgttgtgtaagattcgaaaaaagagaggtttaaaagagttccacagagcaagagtttggaacaaggatcacagagtgactttctgcccctggaacagtagagttttgtttagggagactgagtctctatctgggtatgtagcaagagtagtggctggacttacgggcgccctaaatcttcaccttgtgattctttgaggagtctcttccatccccattgatattgtggtgcaggccttgaactattagaaaaccatgtggcagaagtatattctaagtagaattactctgcctcaccctgatgtcctgtacattatttgatgatcatgatgatgacaacaagtattacgagtggagtggtagtacagtagtctgcacttatccttggggaatttgtcccaggactcccagtggatgcctatcacagatagcactgaatcctagatatactgtgttttttttttcccctgtacatacatagtcatgataaagtttaatttacaataagatattaagaacaataataagaaaatagaacaattacaacaatatgctataataaaagttatgtgaatgtggtctttttctctcaaacttattgtactgtacttgcctatttttggaccacagttgaccctgggtaactgcatcacaggaagcaaaagctctgatgaagaaggtccattgtaggagtagttttggcccaacaggcacagtctttgtcctatcttctaataaattataaaatgactttcttattccacatccctctcttcttttctctattgaattttgggtggacttcttaaagcattactttttgaattataaattataggttcatctagaaaaaatctgaaaaatataaagaatacaacaaaaattttctacaatcccactggccatggattctgattgtttacattttgctgcatttccttgaaatgttttcctttatgtttctctatatacatgcatgccaatgtttgtaattatatactttttaaaaacaaaactgccatgataaatatacacatagtttacatcctgcttcttcacataaaggtatttcatgtaatatttcgcataacattgtgaaggaaaaatatgaattttctttccactatcccctatgtttgtgctttttagagccaatcttcttccccttgtcttgtgccattcatttattcaacagatatttgttgagtcttttcaatagggcaaattctggcttagacactgaggatacaaagctcagaaagaaatgacttctgtgcttgaggagccctttcaattggagagacatgaggaaacaaatcacttcaatgccattttctttgctgccactatcaccagccacttccttgccattatttaaaaataggaattaagctcctgattgcagaaaggactgattcaggcaagatgttagaaatctcgggcagacatgctgatacagaggcacatctgtaagtcagtgagctgttcacatccattggaggttaaggacaactgcatattagcagaagaaagcaagggtcagtatgtaattgggaggagaactggaaaagtgattatagacatggcacaatcagttatttgcccagcaagaccctagagaggattggaagcaaaaaagttgtaagagaggactgattagtggcaccagctggtaaacatgttttctgcagaatgatacctgttgctttagatttcaatatctgcaacatttctatgtctgcaacattgtagccgaagtcatttgcatcaatcctctgcttccaagcagccatatctctctttcagtcatcatgaacagaaatgcttgacttgtactcatcagatttgtggaaagagttctgagagtcaaaaaccctgaaggtcaagaagcatgttgaaatcttactgcagttctctctatccagggcttaaactggctaaataatagtgtagtgggctcttgctgccatgtaagtcatgacattttttttgttcagagatactttacaaagtgtccttgacctatcttctatccgtgaggaagaaccatatatatatatgtgtgtttttgtttgtgtgtgtatatatacacacacacatacttttatactacatatatacatttatactacatatatgtgtatatatatacatacatttatacacacatacatatacctgtatatgtgcatatgtatgtatgtatatgtaaacgtatgtatgtagtataaatttaggcagtacaagtgcaattttgttacatggatatattgcatagtagtgaagtctgggcttttattgtaaccatcacacaaatagtgtatattgtactgattaagtgatttctcatctcccatccctctcccaccctcccactttcagagtctccaatgattattattccacacgcttgatgtatatactttatttagctcccacttataagtcagaacatgtagtatttgactttctgattctgagttgtttcacttaagataatggcctccagttccacccatgttgctgcaagaaccacatattctttaaatgagtccatcacaaggggagaggtactagatccaggttatgtgccacctcatacttgctcagtctgcctgcaccctctcacttggggcctcagctacctgcccagtatcctgttggaatggcccagggaaggctcctgttcttatgtttctaaagttcctgtggacattcccttccctagggacaaaagcctaggcttggttgtactcactgtggcatggtccatagcagttccagctcctggatctggacctacaaggctctggctttcccagagctgcccagaagggccttgtaccacaatataaaagtgcaggaaagataatagcccgtggggagaactttgatcagtaagtgataggagaggggaaaggagccacagatagtgttgctaccattccccttgatggaccgttcttcaacatggccatcccatgtggcttctgagcgactgagtgatggtgttatgttctgctgggaagccaaggtcaacttactgatgcaccaccctgctttggtttcccttccttccctaattcacgtccccatttctgttactcttgctaccccaggattaaactcccttaataaagtgtgaacacaattttttcaaagtgtgtcaatcagggttgaatagttatagctaactcttattttgaattgtaattaatttcaaaaacaaataagaacttcgtaggctgttgtggtcagttcaggctgttataacaaattaccatatactggttatggcttataaataggagttacctatttctcacagttatagaggctgaaagtccaagatcagggtgccagcatggtcaggttctggtgagggctttcctcttaattatgtcctcacccagccttccttgatggatgcacacagagaagagagcaagagagatcttgtgcctcttccttttcttataaggacattaatcccatcatggggctccaccctcaggatcttgtctaaacctaaatacctctggaagatctacctcctaatactattacattgagaattagggcttcaatataggaatttgggaagtgggatgttacacaaatattcagtccttagcacaggccatctccctgaacagttttgcaaaaacaatagatttcatcttacagtataactactagaacaatcaatgacagcaatttgcctacaaggtcatagtgccagtggggtgggaaggactggaattgaagaccatctatctatcattggagtctcttagaaaagtgtgctatagggtgctagctttaggtcagtgggtgtggttttttggggggaaacataaaagtttatgacgagagagctcaatgcaccgaaacataaattctctgatggaagtgggctttgtgcattctcagtcgttaacgtatgtccctgccaaatgcgtcactgaaaaaaaatgaaaagaccaatacatcaccctgggaatatcaaccttccaaaccgtcagctaggtatttctttcaaggtacaacatgtacctattcaacaaaattttccgaaatagaaatggcaccaagaggggaaacccctcaggcataaattcatcacatatgctcaatactcaatgggatgttttcaaattaaaataaggcccctaaagcagaaactaacactttactagatgaagtaaattgaggatattggctgctgagaagttttggcagggctttctgaggtatgtaatatcagtacaaccatattgccacattttcatttctgttgaaaaacttaaaatgcctttcagatgcagtaagttaaatctttaattctcatcgcctgtggcctcaggagcaaaccagaacttttatatccagtccgctgctctatctgttgggggcagaattttcaacactaataaaatattttcttattctctgattcagtcgcagccccaggattactttgctgtaacttttatttggcagctcatttccttcgaggagttgtttgttataaaacccaatgggaaatgaataatatataaatttttaagactacccctattcagctccctcattatggcccactgtgtttttaggagcatatgtgttagcggagtgtttgcagtattcataacttgaacttctaatttatgagctcttaaaagtacactaagcatcggcatactaattattaatattgtgctctgaggattttttttctctagctcttattgcaggcaaaaggaatgttcttaaaagtaatattcggcaacttccagacaagcatggctaggtcaggctggaacatggacctctggcattgatgtgtggatagtaatatcataagaaattatttattacatgaaatgccaaccttgccaatttttaaatgttaatggccttatggtgaagataaaaggtttatactctccacctagagatttcagaattttgtaatcctggcatgggaatggtttcattatctcatgagtcatttttagttctcttttaattataggtgtttatgaacttttataaattaaaaatcacaactttctggaatattgtctataataattgagtcaaaatgactgaatttgatatgctggatgtacggacttctagggaggaaagatttccctgttggttctgggggaaaaaaaagaaccaaaataaattttaagtatattatatggatttgtctaagctaatccagaatgttcagctgcattcataggaaatcctaatttactcaataacttgaaaatatcatctttagcaaattagaacaaattgctcagggcctagcttttcctaagagattttgcctaaatgtccataaagctcttagttcattacttaatttttatttattgtttgtgaattttttttaaatgttcaactaaaaatatatctcatatttggataatattccttaggggtagttcccattgatttattgcatactaatttaaacattttagagggctagccttaaagttcttattttagaatatggttacaacttgctcaaattattcataggatgttactatagttaacatgttatgtgtatgtaatttgtatggatgatactgctaaatctagtagtaatcattacctaaacatgtgcttaatatgaaaaagctatatgcttttcttatctgaagttacttgcaatttcaggagatttaaggaaatgtactgccttattaaaattgagtacagagaataaatagaaattcttgtgactgtccataatgttcaagttagaattttcattaacctctttgacaaacacattttcagcaatgattaagttgcaacctaataaaaatgctaaacacaatttagtaatcatagaagctaactttctaacttcccactagtacaaataaatggaacataggtttaaaaatcactcatattactattatcaaaggtaattttatcttttggtatatttatttctattcttttatctacacatagcctgtttgtgtttttaatagtgcaacattaaaatatatcatgaaattctattttacatgatacttatgctgtaaattttttttgtgtaacttcaaagtctttgtttacataataaaatgactatagagtgttacacagcggacatatagtaatggtgatgtgaagatgccaggcagttctttcttcagaaaacagtgtaaaaagacccatatttggaatttgccacctctatgtcttctccagtgaaaaatttcttcatatattttgctgattttctaattgtttgttaagattgttttgagagtcccttatatatactagctatgagtccttcagggaaattcaaattaaaaccacaatcagatataactacacatctatcagagtggctaaagaataatagcaatgccaaatgctggtgagaatgtggagataataatcacttatgctagtgacagtgagaaatgatagtcactctgggaaatagtttgatagtttctttcaaaactaagcatgcagttaccatataaccaagcaattgcactcttaggcatttatgcagcaaaatgagaacctatgttcacaaataatactgtacacaaatgttcatagcagctattcataatagcttaaaactggaaacatcccagataacctttaaccagtgaatggcaaacaaactgtggtgtatttattccatggcatgcaactcaacaataagaagaaaataacaattgatttctgtctaacttggatgaatctctgaaaaagtatgctaagtgaaaaaggccaatgtcagaaggttatgtaatgtagagttccagttatacaacattttgaaatgacagacttggagaaatggtatacagattagtggtttctaggggctaagagagataggggtggaagggaagtgaatttggtcataaaagggatccttggagttaaggaagtgttgagtagcttgactgtggtggtaaatatgtgaatctacatatatgacaaaattttatagaactacatacacaaacacacacatacatgaatacatgtaaatcagggaaatataaataagatcagtggataatatcagtcagtgttagtatcctggtcataatatcgtactgtagtttttcaaaatgttacaacatataagtaaagtatatgtaggatctctattgttccttacaaattcataataacttaaattatattaataacaaatattttaaaaattggactactatgtctggcatgactggcaaaaactatacatttatggcttttgtacatggtttcccccagtgaactaccccaaccagtcataccagtttgaagtagattatagcaccaagaggacaggaatatttgacctttacaaacgaattctggaagtgagagagatgcaaaagtattgaagttcaaagtccgagtataaactttccccaaatccctggctgaccccagaactgcaaacaccagctactgtacgtagtaggggaaactattttcatagtttgaatctagaccaatcaaattgcctactcaaatgaaaataataaaacaagcaaaccaataatcctcagatgtctcagagtcactacgaggtataatctacaacatttaatttaaaacaagaaattactagatatagaaataaacttgatggtgcttctttgcctgagtttgtgtgacagtcaatggaaactgacacggaatgggccttgatgatatattgagcagataaacatttcaaagaggcaattttaaattcattcagataattaaaggagactataatatttataaataaacagataggaaattgtgacagagaaatgtaagcaataagaaaaaaacaagtggaaattctagaactacaaagtacagtattggaaatgaaaacttcactatatggtctcaaaagcagagttgaaatgacaggataaagaatcagtgaaattggccagcacagtagtttacatctgtaatcctagcactttgggaggctaagacaggaagattgcttgagcccaagggtttgagtccagcctgggcaaaagagggagaccctgtctttacaaaaaataaaaaattagctgggcacggtggcgtgcacttctggtatcagcttctttggaggctgaggagggaggatcacttgagtccaagaggttgaggctacaatgagctgtgattgtgccactgcactgcagcctgggtgacaaaaggagaccctgtctttaaaaagaagaagaagaaattaaagttagatcagtagaaactatcaaatttgaataacatggaaaaaaacatttagcaaaaatgaacaaaaccccagaaaactgtggaacaacatcaaacagttcaacatgtgtgtgaatggggtcccagaaggtgaagaaggagagaaagggacaaaaaaatttgagggaagaatggcccatatcctcttaaatttgctaaagaaaacccactaacttagtcactcaagaagttcaatgaaacccaaataatataaagacacacacacacacacacacacaccaacaatccaatctcagtacgctacagcaagacacctaaaaagaaaacataaaaacctcagaaaaccttaaaaatggcaagagaaaaacaatacattacatgcagaaagtagcaagagaaaaacaacaatatgatcaattgctgatttatcaccagaaataatgcagaccagaagacattcgacttacatattcaacatactgagtaatcaagaaaaaaaaacaaaaacaaaacactggcagccaagaattctataactagtcaaactataatacaaatataaaaatgaaatagaagtttttaggcaaaaacctagaaaatccatagctaacggactagcagtaccagaaacactaaagaaactttgagtgcaaggaaaatgacaccagatggtaatgtggatatgcagaaagaaataagaagcgttgaaaaaatatggtaaaatataaaagcttatacaaatattttgttctctcttttaaatatttttgaaaagacattatagagtttataaagtacattggtgtaatatatgtgagaacaacagcatggaagatagagggtaaatggaactgtactgttttaagattctggtattttaataaaaataataactcaaggtcacatttggtggttcacacctgcaatcctagcactttgggaggccaaggcaggctgattgcttgagcctaggagttcaagaccagcctgggcaacatagcaagaccctgtgtcaactaaaaataaaaaaatagctgggtgtggtgatgtgtacctgtagtcccaggtttataggaggctgaggtggggaggttatttgagcctggagggatgaggctgcagtgaggagtgattgtgccactgtattccagcctgggtgacagagtgagaccctgtctcaataataataataataataataataataataataataataataataattcaatattaaatctaagaaaattatcatgagctaacaatgcacgttgttaaccctaagcaaccactaaaaaaaatgcaaagaaatatagttgaaagctaacagagggtaaaatgacatactaaaatatttgtggaaaaccaaagaaaagctaggaaaggaggaagagaggaataaaaaagggatgagagaaaaaaacaaatagcacgatggcagactaaaatcctgttatataatcatattaaatatatgggtaaatattttaaatgaaaggcagataatattggattggatttttaaaaaccaagatctgtctataaaagttgtactttaaacacagacacaaataaactctaagtaaaaggatagaaaatgatacacactattcaaatagtaagcttaaaaagagggactggaaggaaggacatggtgagagaacaatttgaagagtgccgaagcgtggaagtgtcttctgcccaaaaggcatggtctgaaggtggaactaactatgcctggcagtctttaacctcgggatgctattggggtatccctgagtcctactgatacttcttctcttttcatgctttgagggtcaagaaaacaagaaaactcttacaccatcaacagcatcctcatgaagatccagccaaatttggtgcaaacagagcagaacctgaccctgtagtgcatcatagatgccagcaccaccttgtacatcaagcctcagcacctggtgcttttttagaaggatggcacaacatttttacttctccctaggcaacatagaagtatttttcatttctcaggcttgggtctatgactcagggaaatagaagtacattttggttcagaacaacaaggagaaaaccacgccagagtaccaggtgttagtgaaaggagtggtcagttccagagcaatgcaggacaagaaggaggtgatagaaggcaaagtcttgatggtgaattgttctattccagaggtaaagtcccaacatacttcacagctgaaaaacttgaactagaaacaaaaagagtcaagcaaaaaagagagaatacttctcagaaccagaattttgtgatgctggaattccccaaatgagaagcaagaccatgctttaatattccaatgttaagctatgatcgtttctgggatctgggtggtgaccttggaatccaccagaagtcacctggccaccacggggggtcagagtcctgctctccttttcaccatttttttttttttggtggtttccttgtttggtatgaggagaaagagcccaaaattggaaaggggctggggctttctggatggatttctgttctcaggacttaagacctgttattaatcactttaacaatttatatcggtatttttcaaattatttgactgtgaaatatatatatatatatatataaaatctatatgtcctaaacaaaagttttataaacaatacttgcctttaatgcacatgatacattttgatattttctactctattgtagttttttaaagcactggccatgacagtaaattgattcattatgtaacctgcagtttggaaacccaatgagggtcagacaccaagaagcagggtctggaggagattgtaagggaaggcaggccaggtcctcagcctttgcatttgatgagaagctctccacttttctacctccaccagcccccaacatccaagacattggacaaacaggaaactaatgaggtggcctgagaaatgctctcaggagagaaagaggctaaaacagaggaaagcctgagtgagtatccaggacaaacaggtccccagaagctcccagtgatctatgggggtgggctaggactggtgaagctgaaaagttaggggaaggcacaccctgctatagacagctgcaaatattcccaaagtagaaaacctaatttgtcataaatgaccttattttgacacctctcttcaccccgccaattgtttatgtatataaaaatacctcctatttcagtgattataattcatgtttttggtaaaattttcagaaaatatgctacaatataaagtactaagtgacaatcactcatggtaccactattgagagaaaacatatggtctggactttttttttacctgtacattcacacacacacacacacacacacacacacacacacacacacagagtttttgtttctctttgtttttacaaaaaatggggacatagcaaacctattattttataacttttaaagacacttaatatattacagacttttgtctagatcaagaaatatggttgtacctcattttagcggcaacttggaattctattgtagggatgtgccataatttatttaccccatttttaaaaatggatatttaagtatttcccagttttttgctattaaaacaatcctgcaatgcacatgtctatatttatatcttgtgtacttttgcaagtaatttattattattattatttatggagttaattcttagcactaaagttgttgatgcaaatatttcatacattttcaatattgatatatattgccaaatatctccttcaaatagttgaatactgccatgaaaagtgagtttattttccaaatatttcccaatacatactattatcaatgctttattatttttcccaatcaaattaaggcacaatgatatatcattagtattgtgatttgtattttttttaggttttagtgaggttaagtatgtttcttatgtttattggtctatgctattttcccctataaactgcctgttcataaatactgcccattcttactattttgatttatttgtttgagccctttgtgaattaaagaaaataactctttgtcagagatatgatgaaaaaaaagaaaatataaatgggatatatgaatatcatgtaaattacactttaaagagagttggttgaaagctctaatgtataacatgaagactatagttaataataatgcattgtattcaggatctttgctaaataagaaaattatagctgctcttgctatagaaaggaaaatgggtaactatgtgacctaatagatatgttaatttgtttctctatagtaaacatttaactatatatatatatatatgtgtattttataaaatcaggttgtatattttaaatatttacaataacacttatttaaaaagaaaacaagatttttttcaatccatgaaaaaaagataaagtagtattagtagacgaagagggatatttgattaaaaaaagaatcagtataacaggaacaatggttctataaaactgttataaaagtctgtgtacccagtaacagagctccacattgcatgaagcaaaaactgtcagaattgaaaagataatagacaatttaacaattattagcaagtatagttacaaatttcaaaactcctttctcagtaattagaacaaataggtaaaaaatcagtaatgatataaaaaaatttgcatagtatcaggggaaacagcccccagtattttaacgtaggttcttttctattttccctaaatgtcagccggtctgagaaataaagagaaagagtacaaagagagaaagtttacagctgggcctccgggggtgacatcgcatattggtaggaccgtgatgacgacctggagctgcaaaaccagcaagtttttattagggattttaaaaggggagggggtgtatgaacagggagtaggtcacaaggatcacatgcttcagaggacaattaagatcacaaggcaaaggcaaaattagaattactgatgagggtctatgtcccactgtgcaggtattgtcttgataaacatcttaacaggaaacagtgttcaagagcagagaactggtctgactagaatttaccaggctggagtttcccaatcctggtaagcctgagggtactacaggagaccagggcgtatttcagtccttatctcaactgcattagacagacattcccagagcagtaatctacagacctccccgcaggaatgcattccttccccagggttattccttgctgggaaaagaattcagcgatatctctcctactcacacatccacttataggctttccgcaagaagaaaaatatggctctattctgcctgaccctgcaggcagtcagaccttatggttatcttcccttcttccccaaaatcactgttattctgttcttttcaaagtgcactaatttcatattgttcaaacacacatgtcttaaaatcagtttgtacaatagtgatcctgaggtgacatcctgaggtacattctcagctgatgaagataatgagattaagagattaaagtaaagacagacataagaagttataagagtattattagggaagtgataaatgtccatgaaatcttcacaatttatattcagagattgcagtaaagacaggcataagaaattataaaagtgttaattttgggaactgataaatgtccatgaaatattcacaatttattttctttgcctcggctgcagctggtccctccgttcagggtccctgacttcctgcaacagcataggccaggtgcggtggctcacgcctgtattcccagcattttgggaggccgaggcaggtggatcacctgaggtcaagagttcaagaccagcctggccaacatggtgaaaccccatctctactaaaaatacaaaaattagctgagtatggtggtgcatgcctgtaatcccagctactcaggagcctgaggcaggagaattccttgaacccaggaggcagaggttgcagtgagccgagattgtgccactgcactccagcctaggcgacagagtgagactccatcgcaaaaaaaaaaaaaacaaaaaaaacagaaaaaaaaggtttgaacaatatgaaccaacataaagaaactggcatttataaaatagtttatgcctaaacagaataatatatattcttttcacaaacacatggagcattcactaagatataccaaatgcagggtcataaaacaaatgtcaacaaatacaaaaatatttaaatcatatgatgttttctctataatagaattaaattatgaatttataactgaaaaccatctggaaaatcacccaaatatttggacaataaaaaatacagttataaataacccatgttcaaaacaaagttacaaattttacttctgggtgtatatccaaaaaaattgaaaaaagtgacataaagagatatttttatactcacatttatagcagcattattcacaatagctaaaaggtagtattaatccaaatgtccattgttggataaatggataaacaacatgtggtaaatatgtacaatgaaatattattcagccttaaaattaaggaaatttggacacatgctacaacatggaagaactttgaaaacattatgctaagtgtaataaaccagaccaaaaaggacaaatattgtatgatttcacttatgtgaagtacctagaattgtcaaatttgtagagatagaaagtagaaaggtagtttccaggggttcaggaaaaggaatcaggagttattgtttaatgggtaaagttttagtttggaaatatgacaaagttgttctagagatggatggtggtgactgctgcacaacagcataaatgtacttagtgctactaaactgtacacttaaaaggattaaaatggtaaattttatgtattctgtatcatcatataaattatttaaaaactagaaaacattttaatagcaaaaaatgaaagaaaagcatattagattttgtggattgtggctaatcagtgttcagcagcacttttatagatttaaatgcttgtgtttaaaaggtgaaacatctcaaatcaagatctaagcttgcaccataggaagctagcaaaaaccagcaaactaattaagtagaagaaatgaattaataaaaataagagcataaatccataacaggaaactttatgaaaaattttatgccaataaatttgacactttagatgaaatggacaaatatcttgaaaaacaactcaccaaaatagcctcaagaagaaatagagcacttagataaccctatatccattaaaaacattaaattggtaatttaaaaatgttctgagaaagaaaacgataggacatggtggcttcactagtgaagtctatcaaatatttaatgaagaaagtgtaacaatcttacaaaaactgtttcagaaaatagaagagggttcacttcccaacagattttacgaggccagtattacactgataccaaaaccagattaagatattcccaaaattgaaaactacagaccaacagctctcatgaatatagatgaaaacattcttaatattagcaaatcaaattcaacattatataaaaagaatagttcatcacatacaagaggctttaatctcaagaattgaagatttgcttaatattcaaatatcactcaatgcaattcatcatattaattgaataaagaagaaaaattctttggccatcttgatagcagtagaaaaaaattcttaaaaattaacacttattcatgataaaaatttcaggtaactagcatttaaaaataccttcccagcttgataaaggcttctataaaagattcacagtaaacataatacttagtaaaagactaaatttgttataccaaaaatatggaataatgaagaatgtctgctttcaccatttcaattcagtattgttctagaggtctaaatcagtccaataagggaagaaaaataataagattgtacaaaaggagaaaaactatctctatttgcagatgatattgtcatatatgtagaaaatcctaaggaatatatttaaaaagctattagtgccttcacaaggcatgaaggcaatatacaaaaaaaggactgcatttctaagaacagtaatgaacaactggaaaatggaattaaaaatacaattgcattgacaatggaacctgaaataagtatagcccttagaaataaatttaacaaagatatgtgagacctgtatagtaattattacaaaacagtgctgagataaattaaagaagacctaaataagtgaagaaagatgccatgtttgctgtctgaagtctccatattgttaacatgtccattatccaatgaacatataaatccaatgcaattcccacaaaaatccacatatggaaatacaagatatctggaattgccaaaataattgtgagaaggaagaaagttgaagggcttacagtaactgacctgaatctacagtgaacaaaacaatgtggttttgtttaaaacagtattccccaacctttttgacccaaggaaccagtttcaaggtagacaatttttccacagatgggttgggatggggtgggactcaagcatattgcatttattgtgcactttatttctattattattacatactcaccataatatagaatcagtgggagtcctgagcttgtgttcctgcaactagtcggtcccatctagcagtgatgggagacagtggcagatcatcacgcattagattctcataaagagcatgcagtctagatccctctcatgcacagttcacaatagggtccatgatcctatgagaatctaatgccaccacccatctgacaggaggcagagctcagcttcgctcactctcctgtcactcacctcctactgtgtggcctggtttctaacaggccacagaccaaaactagtctgtaggccatgggttggggacccctggtttaaaagatagacaaagaaatcagaggaatagaatagaatccagagatagatccatacatggtcaactgattttcaaccaagatgccacattagttcaatgggaaaaggagtctttgtaacatacagccttggtacatttgatacaatagacaaaataattcctccacccccaccccaaagatgtccagattctaattctcagaacctgtgaatgtgtttggatacatggcaaagaggaattaagtttgcaaatccaattgttaactttaaaataggaagataaactgggttatccaggtgggcccactgtaatcacaagtgtttttgagaggagagaggcagaaaagaaccagagagatggtagaggagaataactggtccaatgttgcaggctttaaagatggagaaagaggccatgagttacagaatatgagttgcctcgggaagatagaaagggcaaatatatgaattcctccctaggtctccagaaagagatgtagccttgctgacaacttggacttctaacttatagaattgcacaataatatatttgtgttgttttaaaactgtaagtttgtgttaattttctatagctgccatagaaaagtaatataattaagtatctctctggggtgaaatacagaagcatctcaaccctgatatttatataatttacaaattaaatggaaataaattgtaaacctaaatgtaaaacctaaaaccataaaacatctgtataaaaccaggaaaaaaacccattgtgttcttggtataaccaaggatttcttaagtatgatacaaaaagcattaaccagaaaagaaaaaaaattataaattggactttatcaaagttaaaaaccatttatttttgaaagactcttaagaaaaaggtaattgacagatcagtaaaaaatatttgcaaaaccatatatctgactaagaacttgtatccagaatttgtgaaaaacttttacaactcaataagaaaacatgtaacaattaagaatgtgcaaaaatttgaacagacacttcactgaggaagatacatgatggcaaataagcatattgtatgtgtcccatcctgctggtcatcagcaaaatgaaaattaaattcacaaacaagcactggatatccactaaaatggctgaaattgaaaagactcactatactaagtgttggcaagtatgtaaagccaatggaagtctcattcattgctgatagaaatgagaaaatgttatagccactttggaagacagattggcagttttttataaagttaaacttgtacttgtttttatgactcatcatgggttcctttcctggtttattatctacccaaggaaaatgaacatgcatgggattaactgcgggggattaactgctcaactgatactgtctaccttagatttgtaatgctgcagtgaatattcaaagcggcattatttgtaaaatccaaaaattagaataagccaaagttttcatcagctgatgaatggataaggaaaatgtggtatatccaaacaataaaacactattaaacagcaaaaaggagcaaaccacttaaacatgcaccaacatagatgactctcaatagatacttcattgttatactgagcaatagaacataaatccaaaagattgtgtattatatgtttccattcatatgaaattctagaaaagggaaaactatagtgacaggaagcatattggtggttgtccaggagagatgagggaatttactgcaaagcggcaagagaaaactgagatgagagaaacgtctgtcttatgtggtggtagttacaaggctgtatactttgggcaaaacacatcaagctgtgcacttaaaatagaatttgcatttattttatgaaaattatactttaatgaatatcttaaaccattaaaatataatgtccctatagcatttgtcatgcttatgctaacagtaattaacattaataatgaataacatttactgagttcctactagtggatttgtacttactgaacttacatttttaaattatgaaactctgtgaatctcagttgctttatggcagtattgaaaataaacaggaaggcctggcctgatggctcatgcctgtaataccaacactttgggaggttgaggtgagaggattgcttgagcccaggagttcaagaccagcctgggcaatatagagaatcctcatctctacaatttttttaaaaaaatcagcaaggggtggaggcacattcctgtagtcccagctacacgggaggttgaggtgggaggatcgcttgagcctaggagcttcaggctgcagtgagctatgatcatgccactgcactccagcctgagcaagagtgagaacctgtctcaaaaagaaacaaaagaaaaagcagaattggttatttgaaatacatcaactagtatggcacaggaaccaattaactgaaacgcacattggccagttagaaaggtcttggtgtaaatagctggtataggtgaataggtacacaatttcacatcattcctagaaataataacaatcatgtctacctcaatattgccatagaattaaatgaaaggaggcatgtgacatgcttagcacagtgcttgacacataactatccctgaatacaaggaagttgttaccctgcatgaaatctgagctttctccatgggaaaatcatgatagtagcagtcaaatgttgtttctacctgttcaacataatcttcccctttcttcacgtaagaaaacattttatttttcctttgggtaactgccgtggtgtcctattaagcagttaatcccgtgggggcactcagggagagcccctcaggttctttgattttgttactataattcataactaattttatattctgtctcttatattcctatattaaataattaggtgtctaaatctgattgtttgcttgcttttgctgactctctcacccatggtggtttgtgggctcctactggttgaccttaatgcattggaaacctagggggttacaccggggataatttccaccatgggggatttgcttttgcatttgctaagggccaggggatattagcctgggacaactttaaacccttcgggggccacaggctaaatctaggaatctcaggttctgctcatctaatcatctctgatagtcatgttctcctgaaatctagacatagacaatattcaagcgtatgcatacataacctctgacagtgtatcagatgtctcttatacagcactttatataacctctttgtgccatctctcactctagccactgatgcaatgatggcctcttccaagttttgaccagctttgtgctggtacaaccttatgtgttctttgacctctaggctgcagtgattaggtaagaaagggccctcaatccaagtcaggccaattagaattttatctgagatttggtagctcatcaataaaggtgcatatttgaggttacttgttgctatcttctgagccttctggaaacatgagcctgagaatgaagcccacatactatcagaagaaataaaagctaagtgaggcagagtgctagggacattgtttatgcttctgagtcagatgaacttgtgaccttctagttttatgagtgaataaaatatctcctcccaccccttttacctaaactagtttgatttgggtttccaccatttgtaaccaaaagaattcactgtttcagacattgctttcaccaagaatctttcttcatgcacacaattgtatttatctcttatggcttgtattttcttatgcatttgaaacattagttctcatgattcattaataatagtaaattttgaatattgtgtgataaaccgattgaaaagaaaatgttcttaggccattgtatacaaggctatctgatatttctgacattttggctctttgaggcagtttgcatttgaactggtgataggcaatgcatgtatctttggtcagtcctttgaaacaaatcatgacaacttttggagagttttaaatatctattcagacttagccacagcatgttgatagttctttatctgaaggtaaaataaaaacttttatgtttcttattatttttaaaaattttatttattttggattcaggggtacatgtgcagtgttacatgtatatattgtttaatggtgaggtttggacttctagtgtacccatcaccccaaaagtgaccattgtactcaatagatagttccaaatacagcatagctggcactcatgatacttacaacatttcatttgtggattattttaaaattcgtattcatgaacatcctgataatcctccctctccctctagaaagctttggcttttgaatcttggttccactacttcctggcagtaagaccctgagcaagtttccagataactctgggtaggttccttgtctcaaaaataaaggtgatgattgtacctattttgcaaaaggttgtaaggattaaatgaataaatgaagtaatgtgttcaaaaggcttagaacagtgtctgaaacctagctaattctagagaaggctttgctgttgttattattaaaatccatttttcttcttgaagctgtgttttgataggctgaggaagggtttgtaagacataggtataaaaatttttaacagccattgtcattaatgactagattaagaaattaattaaatgaaatagataagaaattttacttatatgtataacaaagttattcatttcaaatgcattttccataccaagtgttttgcctagagtagggactcaatattggtcaaatgaaattgactcccagtagtttacaatcaaagcatacacaataactttgtttcctttatgacagtggcaagttcacattgtcataggtgacttgcttagctagttgtagttatatcatctgtgagaaaaaccttaacaacaataacgataaaaaaacattttagccataaaatgaaagcctttctacaatggattgtggctttctccaccatcttaagttgcagtttgaacagaatttcatgttctgtataagatgcctaggggttatcctttttactgttatcgaaccatgtgggaaacagaggtatcttgaggtacctttgctgattcaagaggagtatgctttttgaatacttgcatacaatgctatgttatttttctatactttgcctcagtattagacagcacttctttcaggaagcgtgccttaagagctttctttctatttataatttatttgttaataatattcacaggaaaatgaaataggtaacattgttaaaagtatgtctaagataaaagtaaataagtcattagtgagtacactttcctaagacttaaataccttagctggtgatgtttacacatgtcggtgcctcaggactctgtttggggtcttatttaacccaatctctcatcccagttgaattccacatatgaatttgcttgaaaaagttccccatgtgaatgaatgatcattataaagtgctctggtaattccatgagctcaactggtggtctttattcaatgttagtttttctaatgggtgatttaggtaatatgacttttctttggttatgtaacatattattaggaaaacattaggatttaagggtaaaacttcctaaataatattctcaatataccacttgcataagtagtggatttttcaatagtataaaaattaaatttttgatcagaattgtctaagtgttatggtctttgctaaatatctgatagatgcctaaatttgcatttacatcttgctaaatgtgtaaaatagtacatacatagtgacttaaagccaagtcaggatttggcataaaagctttactaggcccttctgtaagaggtgataagagacactgagaaaaaaaaaattgaatacatcgcttgtagtcaactatacactcagaaattgaatctcccttacaatgaagtacagtaagtcatgatttaaaataacaaattaggaagttcagtgtcactaacaacatacagacatgatacagagcttcctaatttctttctcaatatttgggttctaggcaacagctgtgggggttatagtggcatttccctaaatgctagtatgatttcagaagagacttccacaatatggagaagtcacaattttcatcattagtttaaactaaggcaccttatctcacttcctctaagtcacataattctcattttatgttaatagaagttaaacctaattatcaaggggagagtagatttctaagttatagtttcttcttgaagagttatgagtgtaacctccattaacactaggccatgttaaaaaggcaactctttgaatgttgggataaaaatacatccctctagtggagggttatattttatctgtaactgagtaatttggactcaagtgacctacattgagaaataggtttaatagtgaaaagactgtggattgatggatccctgccaggcaggaactgaaagttcagagcattagcagtagctgacagaatataggacatgatgttattcccaaaattatcaggaagagaaaatataatagagaggaaaaaatagtgtgagacgatttctactcccacctccccggatgttcaagctaatgtttccttagatgaagtttttgcatcagatttcacttttcaaaaagttcagccttttacagactctctcccagtgagaaataaaccgaaagcttttgtttatttttgtagtgatcactgtgtcctcactatataattctctgaagcccacttgttggtattctaagaaaatttgctgcctcatatgagataaaactagcatacatggtaatcttccaatataaagttaagaatgtgtcctagtcatcttgcaagctaagtgtctctaatagcattgcttctccatggaaacactacttttgggagtaggctatcttggttctcttcctctctccctccctcctcctcccctcaacctgcctttttccccctctccttcctccttttcttccttttcttctgcctcccccccttcttcctcccacgttagttcccgtaacattgctgaaaaaaaatctgtcccagattttaagcactttgaaattcttatgttaggaaatgtatcctgaatttaatctgattattaaaaaagaactgcagatttaatttcttataataacttgctactatgttattgactttatatcttcaggatgtagctaaagtcatctaaagtaggtggtatagatgaaaagaataaaaaaaccaaaaccaaaaccaaaccaaacccaagccatgtctcttcaatacataatacagactagaaactgtttcagaaatttagaaactacatcactgatttgtttttctgtactagatgctaaaaggaatttagatgtgcttgtggtgcatcattctatttttaaaggtgatttcatgatgggcaatcgtcgagccacaaatgttcctctgaaagatgcagaatcctgagttggataaacttggcttctgagtaagtgtggccttgttctttgaacacagtacttgcatctgtaagatccctgcctgcatgatctaattatttctgggcttggggtctataaaccagacattctgacacttggttgctgcttttctcagcatttggttttcttttaaggttgtaaattgatcccccacgtaagacagtcttaggcaatacatgacttcttattaaataatgactaatatcattaagacaataaaatatttccataaacaaataattaaacccttataagacctaggtccaaattgaagtcccattctctcagccctttcaggttttgggactgattttttatttaaatcagtgacgactgcaggcttaagcatgtactataggtccattaaacgttgcttcaaagagagagggaaagaaatggcctctaatgatccccaactttctggcaatcataccctgtcagtgaaaggaataaaaaagtactgaaaagtgaatagaaaatgtgaagcttttaacagtcttctatttactggaggactggccgttaccgtcactcaaccattaacccccgtatgccttggcctgggaacatctcatttcaaatctctctgctttaaaatctatacataccgataatgagttccaagacaaactgtaaagtgcaaagcatcaaggaggggagcaggtaaacatacatgcaaatacacatgcatgtacaatatatatacaaaacaaatggagcatctctggaagcatacgtaacacactggcaatgatgacactgcctttaaaatggaacagcgaaagaagataaacttaatttttcggtatttttttttgttttttgagttggagtctcgctctgtcccccagtctggaatgcagtggtgccatctcggctcactgcaacctatgcttcttgggttcaagtgattcttctgcctcagcctcccgagtagctgggactacaggcacataccaccatgcccagctaatttttttgtatttttagtagagatggggtttcaccatattggccaggctggtctcaaactcctgacctcatgatccgcccaccttggcctcccaaagtgctgggattacaggcatgaggcaccgcacccaacctatatgttcctttttacctatttaaattttaaaaagattaaaagtacctactcctgtgtaactattcataattctaagctggtatttaaagttgatcttctcaattaggtatttcctaattgtgcatcaagtttgaaagaagatgcatactctactacgttggccagaatctctgatacacatgttggttaaataatttatttataatgcaacagatggaaaatgaccagactatgctggtgattagggtctaagtcttttttattgtagggtcatggatactctgttatgaaagaggtgaatcaatgggacacatttttatatacccaacccctgggtttgtgcacatatgtgtctttgtggaatattatggaatgtctgaacatattacataatgtgtaggaatactacaatgtgtctgaaccacatgttgcaattaatgctctagggttaaataaaaattttgaatggattagaaaataggcagtctctatcagataggtatggttgagtaaaaattcactcaaaatatgttgacttaaaataacaattgtgtatttggcttatgattctgctgggcagtactagtgtgtcttccttgtgtgtctgtggtcagctgtgagtgaccacagtagagctgtaggctggctttggtggctttgctaatcaatgtgggtctggcaggtgtctgggacctcaactggcataagtaggctgactggcctctgacccacattgtatctcttcctccggcaggctagcccaaagttatgctcatgactgaggcagagtccccagagaccaagtgagagcccacatggcttctggaggcctaaatctggaataggcactcagccccttttgctgagttcagttggccaagcattccatagccagcaatcatccagtggcctaagaaatacacctcacctcttgatggagggccatcaaagccatattgccaggggagtggaaagggaaccacagtgtccacatggtcttgagctttgggaaaaggatgctgagtgaggtggatactacatatttttaaaatttttaaaaattttccacacagtttgaaaaagtgtaattaattttaaactttgctttggtactgtgtcataattttatatcttttatttattttcacattcttctaccacaataataatagctgttacttactgagcactcacaacatgctggatactatgctgcccaggaggtgttttagatacatttacattttgccattacaatgtaaggtagatattccgatttttcagaagagtaaactaaaaattttatgaattcaattatgagcgcactacattggggtcagggatggggactgagcgaaagcaaaagggaaaataatttaaataataagggcagtccaaccagccactctacccagtgagtgtacgtcctacaggaactctgagttggactccatgactttgctgttacctcagttaattacagctcccacgtgcttctgaggctggtgtgattctgatatttttgtttccttttattaatataattgtaaataccagctagttcctttatctcatcttcaatcagagaaaaagtgatcaaattagtgttaaagcaaaaaccatctatcttgtacagactatgagttgtagttcagtctctggtgtaccacatcactggggaattttcaaggataattttgacgctatgtatttttccttttaagagctaaggaaacttcagtaggatacaaattcagttaactatgttgtattttctggaagggggattttaatgtttgtgtaataaaatgcctttctaaagtggggtataaaatatttattttgcaatcttcaggtgtactaatctggttaaacacatcagaaaaataagtgacgttactatgacggtgtctactgcaatgccattttgtggaagaactagactccgcattatgttttatgaatgaatcactagttaattaaaaaatgttctgcagggaagatgatagttttgttattaagaattctttgctgttgattgttataaagttaatgtggaaaacagtatataaattgaagtgagcaaacaaaattatcttatccgaagcattctgcttttattttttatggtttaaattttattaaaatataatttacatggagaaatgtgcacatgaaagtggaccattcaatatgttttcacaaactgaatacaactgtgtgactagcactcacaaacaagcatcttagaagcccactcctgctcccttccagacacaaatctccctactccccagagtaaccactatttgggctttttaattgtatagattaattttgcctgtattgtatttcatagaatagaatcctatatagtatgtacttcctgtgtgtgtctgaggtctttcatttagcattaagtttcaaagattggtccaccagactacatgtcattgcagatggttcatttgcattgctgatgagtgaatataccaccattcatccactaaactgggatgagcatttgggtagttcctagtatggggctgtattgggccatttttgcattgctataaacagatacctgagactgggtaatttataaagaaaagagttttaattgacttgtggttctgcaggctttacaagaggcatggtgctggcatctgcttggcttctagggaggcctcaggaagcttacaatcatggtggaagacaaagggggagcaggcaatctcacatagccgagcaggagcaagggaaagagagagtgtatgtgtggagggatgccacacacttttaaatgaccatatctcctgtgaactcagagcaggagctcatttatcaccaagggaatagtccaagccattcatgagggattcaccctcatgatccaaacacctgccactatgcctcacctccaacactggggattacatttcataaatactttaatacatctttttatgaacacatatcatatttctgttgtgaatttatctaagaatggacttttggtttatggagtgtgcatgtttacatctttggtgagaaacatcacttctcaaaagtggttgccaattcactgccattagaagtatttgagagctcctagtacttggtatttttcttcttttttatcttaactagtatggtttcctcttacctaaaacattgtaattattgaagtttcctgtactaaatatatataatctcaatgtttcaggttaacaactctaagaagacaattattaaaagacacctctgatgattccagggaagatattactcttaaaactatcacagtaaactcaccttcatgaaaatatgacacagaataattgaaatttaagttaaaagtgatggtagctggtttgtatgtatcttttggtcttctttatcttttaaaaccattagtaatgactaatgtgtactgtacactcatttaaaaagactcatttaaaaagactcaatgcaagacaatctttttttttccctcattttgtccagtgactttagttttctttcctaactatgaccaaggtctcaagttagaaaacagtattttcaaagcagtcttgtgcattacaatcctgtgacacaattctatgcagaagaaatgcctgtggttttattatcttagcatatgcctcaaagaagatgcccatctgtacatgcaagtttcccttttgcatctgaaaagataaaatgtctctcaaaatagtaactctctcaagggcatgtaatttttggagaattgaaggtttcatcagtattttgtttgggagctatgacttataaagtcagtaatagaattcttgtgaattgcttaactaaattaggaatctaaaagttaaaattacagaaactataggaaggctctcctcaaagtcaatagtggtatgactttaaagttaccgtttctcagttgtaagtattgtgttgcaatacaaaaggctttatcaatcaaggatatagtcattttcagataatatcaactgttttgactttattgtgtgagttactttaacattaatgcacagattaactactacttgtttcagttattcgtttaaaataagtcttatgaaaagagactttatatgcaggtcatgaccattctgaggtgtattttttatttatttatttatttatttagagatgaagtcttgctctgtcaccaggctggagtgcagtggtgtgatctcggctcaatgcaacctccgcctcccaggttcaagtgattcccctgcctcagtgtcctgtgtagctgggactacaggagtgtgccaccacacccaactattttttttattgtattttagtagagacagggtttcaccatgttggccagaatggtctcaatctcctgacctcgtgatccacccaccttggcctctcaaaatgctgggattacaggcatgagccactgtgcctggctgtgtaatcttatgggtgaatagcgactgatatgaacagaatatctttgaaatttgtaagccaaacttgcaactttgagggagataaagaaacaatttaccaaacaatatggaaaacactgaaatccccaaagaaagggaaaattaaatgtggcttttactaggaatttaccatattaacatcctacctggcacatgataagtgcccaatgaatgataaccaaaagaaaaaaaccataatgttaagtgtggttactggctctattttacaaataaagatgttgaaactcaaagggattagaataagtaatttgttcaaatcatacagctgatatgtttgagaggtaggattcgagagacaggattcaaacttattaaacaagacttgtcaagtgcttccaagatggccaaacaggaacagctccagtctgcagctcccagcgagattgacacagaagatgggtgatttctgcatttccaactgagatacctcgttcatctcactgggactggttggacagtgggtgcagcccacggagggtgagctgaaggagagcggcgtgtcacctcacctgggaagtgcaaggggtcaggggatttcccttttctagccaagggaaggtgtgacagactgtatctggagaaacaatactctcctgaccaaatattgtgtttttcccacagtcttagcaacgagcagaccaggagatactctcccttgcctggctcggtggctcccgcgcccacagagccttgtttgctgctagcacagcagtctgagatcaacctgtgattctgcagcttcacagggggaggggcgtccaccattgctgaggcttgagtagctcacagtataaacaaagaggccaggaagcatgaaatgggtggagcccaccacaactcagcaagtcctgctgcctctatagattccacctctgggggcagggcatagtagaacaaaaggcagcagacaacttctgcagacttaaacatcccggtctgacagctctgaagagagcagtgattctctcagcatggtgttcgagctctgagaacggacagactacctcctcaagctggtccctcacccccatgtagcctgactaggaaacacctcccagtaggggctgacagacacctcaaacaggcgggtgctcctctggaatgaagcttccagggcaatgttcaggcagcaatatttgctgttctgcagcctctgctggtgactacaacagacctgtagctgatgggtctgactgttagaagaaaaattaacaaactgaaaagaatagcatcaacatcaacaaaaaggacatccacaccaaaaccccatctgtaggtcaccaatatcaatgaccaaaggtagataaaaccacaaagatggggagaaaccagagcagaaaagctgaaaatttcaaaaaacagagtgcctcttctcctccaaaggatcgcagctccttgccagcaaaggaacaaaactggacagagaatgagttagatgagttgacagaagtagacttcagaaggtcagtaataacaaacttctctgagctaaaggagcatgttctaacccatcgcaaggaagctaaaaagcttgaaaaaagtttagacaaatggctaactagaaaaaacagtgtagagaagaccttacatgaactgatggaggtgaaaaacatggcacaagaatttcatgacacatgcacaagcttcaatagccaattcgatcaagtggaagaaaggatatcagtgattgaagatcaaattaatgaaataaagtgagaatacaagattaaagaaaaaaaagtgaaaagaaatgaacaaagcttccaagaaatatgggactatgtgaaaagaccaaatatacatttgattggtgtaccagaaagtgacggggagaatggaatcaagttagaaaacactcttcaggatattatccaggagaacttccctaacctagcaaagcaggccaacattcaaattcaggaaatacagagaacaacacaaagatactcctcgagaagagcaaccccaagacacgtaattgtcagattcaccaagattgaaataaaggaaaaattgctaagggtagccagtgagaaagctcgggttacccacaaagggaagcctatcagactaacagcagatctctcggcagataccctacaagctagaagagagtgggggccaatattcaccattcttaaagaaaagaactttcaacccagaatcccatatccagccaaactaagcttcacaactgaaggggacataaaatcctttacagacaagcgaatgctgagctattttgtcaccaccaggcctgccttacaagaactcctgaaggaagcactaaacatggaaaggaacaaccggtaccagccactgcaaaaccatgccaaatggtaaagaccatcgaaactatgaagaaaccgcatcaattaacaagcaaaataaccagctaacatcataatgacaggatgaaattaaaacataacaatattacccttaaatgtaagtggactaaatgccccaattaaaagacacagactggcaaattgcataaagagtcaagaacaattggtgtgctgtattcaggagacccatcgcacgtgcaaagatgcacataggctcaaaataaagggatggaaggagatctaccaagcaaatggaaagcaaaaaaaaaaaaaaaaaaaaaaaaaatagcaggggttgcaatcttattctctgataaaacagactttaaaccaacaaagatcaaaagaaacaaagaaggccctccataatggtaaagagatcaattcacccagaagagctaactatcctaaatatatatgcacccaatgcaagagcacccagattcataaaggaagtccttagggacgtacgaagagacttagactcccacacaataataatgggagactttaacaccccattgtcaatattacacagatcaatgagacagaaggttaacaaggatatccaggacttgaactcatctctggaccaagcagacctaatagacatctacagaattctacaccccaaatcaacagaatatacattcttctcagcaccacattgcacttattctaaaattgaccgcataattggtagtaaaacacttctcagcaaatgtaaaagaacagaaatcacagcaaactgtgtctccagccacagtgccatcaaattagaactcaggattaagaaactcactcaaaaccacacaactacatggaaactgaacaacctgctcctgaatgactactgggtaaataatgaaatgaagggagaaataaagatgttctttgaatccagtgagaaccaagatacaacataccagaatctctgggacacatttaaagcactgtgtagagagaaatttatagcactaaatgcccgcaagagacagcagggaagatctaacatcgacaccgtaacatcacaattaaaagaactggagaagcaagagcaaacaaattcaaaaggtagcagaaggcaagaaataactaagatcagagcagaactgaaggagatagagacacaaaaaacccttcaaaaaatcaatgaacccaagagctggtgttttgaaaagaccaacaaaatagatagacagctagcaagactagtaaaaaataaaggagagaagaatcaaataggcacaacaaaaatgatgaaggggatatcaccaccaatcccacagaaatacaaactaccatcagagaatactataaacatctctatgcaaataaacttgaaaatctagaagaaatggataaattcctggacacatacaccctcctaagactaaaccaggaagaagttgaatctctgaatagaccaataataggttctgaaattaaggcaataattaataaatagcctaccaaccaaaaaaggttcaggaccagacagattcacagccgaattctaccagaggtacaaagaggaactggtaccgttccttctaaaagtatttcaatcaatagaaaaagagagaatcctccctaactcattttatagggctagtatcatcctgacaccaaagcctggtagagacacaacaataaaagagaattttaggccaatatccctgatgaacatcaacgtgaaaatccttgataaaatattggcaaaccaaatccagcaggacatcaaaaagcttatccaccacgatcaagacagcttcatccctgggatgcaaagctggttcaacatatgcaaatcaatacacgtaatccatcacatacacagaaccaatgacaaaaaccacatgattatctcaatagatgcagaaaaggcctttgataaaattcaacatcccttcatgctaaaaactctcaataaataggtattgttggaaatgtatctcaaaataataagagctatttatgacaaacccacagccaataacatactgaatgggcaaaaactggaagcattccctttgaaaaccagcacaagacagggatgccctctctcaccactcctattcaacatagtattggatgttctggctagggcaatcaggcaagagaaagaaataaagcgtattccattaggaaaggaggaagtcaaattgtctctgtttgcagatgacataattgtatatttagaaaaccccatggtctcagcccaaaatctccttaagttgataagcaacttcagcagagtctcaggatacaaaatcaatctgcaaaaatcacaagcattcctatacaacaagaacacacaaacagagagccaaatcttgagtgaactcacattcacaattactacaaagagaataaaattcctaggaatccaacttacaagggatgtgaaggacctcttcaaggagaactaaaaaccactgctcaacgaaataaaagaggacacaaacaaatggaagaacatttaatgctcatggataggaagaatcaatatcatgaaaatggccatactgcccaaggtaatttacagattcaatgccatccccatcaagctaccaatgactttcttcacagaattggaaaaagctattttaaagttcctatggaaccaaaaataacctgcatagccaagataatcctaagctaaaagaacaaagctggaggcatcacgatacctgacttcaaactatactacagtgctgcagcaaccaaatcagcatggtactggtaccaaaatagagagagagaccaagggaacagaacagaggcctcagaaacaataccacacatctacaactatcagatctttgacaaacctgacaaaaacaaggaatggggaaaggatttcctatttaataaatggtgctgggaaaactggctagccatatgtagaaagctgaaactggatcccttccttacattgtatacaaaaattaaccaagatggattaaagacttaaaggtaagacctaacaccataaaaaccctagaagaaaacctaggcaataccattcaggacataggcatgtgcaaagacttcatgactaaaacaccaaaagcaatggcaacaaaagccaaaatggaaaaatgggatctaattaaattaaagagcttctgcatagcaaagaaactatcatcagagtgtacaggaaacctacagaatgggaggaaatctttgcattctgcctatctgagaaagggctaatatccagaatccaaagagaacttaaacaaatttacaagaataaaacaaaccactccatcaaaaagtggtcaaaggatatgaacagacaattctcaaaagaagacatttatgcagccaacagacatatgaaaaaattctcatcatcactggtcatcagagaaatgcaaatcaaaatcacaatgagatacaatttcatgccagttagaatggcgatcattaaaaagtaaggaaacaacagatgctagagaggatgtggagaaatagaaacgcttttacactgttcgtgggagtgtaaattagttcaacgattgtggaagacagtgtggtgattcctcaaggatctagaactagaaataccatttgacccagcaatcccattactgggtatatacccaaattattatgaatcacgttactataaagacacatgcacacatatgtttattgtggtactattcacaatagcagagacttagaatcaacccaaatgtccatcattgatagaatggcttaagaaaatgtgacacatatacaccatggaatactatgcagccataaaaaggatgagttcatgtcttttgccagggacatgggtgaagctggaaaccatcattctaaaccaatgatcacaaggacagaaaaccaaacaccacatgttctcactcataggtggaagttgaactacgagaacacatggccagggtggggagcatcacacaccgaggcctgttgggggttgtgggactgggggcaggatagcattaggaggaatacctaatgtaaatgacaagttgatgggtgcagcaaaccaatacggcttatgtatacttatgtaacaaacctgcacattgcgcacatgtaccctagaacttaaagtataatataaaaaacaccaagacttgtcacctttcatctatctaaatgatgaagatgaaaaacataatatagtaagtatttgttttgtatggtagtgacatgcacaaatttcattcaccaccagttaattcactagcaagcagccctccaaaaacacagttcaaatttcagttaccacagaatattaactgtaattgtatgaattccaatcttctcttactagttcttcaatccacaaataactacataaataacagatgaacatcataaccagagacccatgatgtcatttctttcaaagcccattggcaattggtcactgtgcaccggttatttatattatgcacagacagcaatgcatgtagttgtgttgcctcttgtctgccagtgatagaactacatgaagttttatagaaatggataattgaattaaggaattggccaataaatatgaaaatggaggaaggaaaccaaaaacgataatactggaactgaaattaaaactgaatgtgggtgaaatcagagaagaaagagctgactgtgggaacattgacactaccatcatttgagagattctacatgtgtagccagaggaacttagtgaaggtgaacttgtcaatataaatgagaaaagtgattcatgtgaaagtatgaagatgtcccagagaaagtgacattagaaaaaagttttcacattcaagaaactcctggtgatatttcatgacattgaaatcccaaaggataaaatgttggaagccgattgagacttagaagggagtatgacaatttgccaaggtatagaaaagatttggcttgagtatagaagttctatgatgagaagaggaaggcaaacactggttaaactactcttgataagtttgtttggttttagagttgaggtcttgctctgttgttcaggctggagtacagtggcacaatcatagctcattgaagcctcaaactcctgggctcaagagatcctcccatgtcagccacccaagtagctgggactacaggtgtgtgccactgcacttggataattttttatgtatttttatttttattttttttagagatggggtctccatgtgttgcccaggatggttttgaactcctgggttcaagcagtcctcctgcctcagcctcccaagtagttggtattacaggcacaagccactgtgcccaactttttgttttctttttaacaaagaaataaaataccttgtcttatctcagactttcataacaaaatacaattgactgggtgatttaaacaacaggaagttgtttctcacagttctggaggctgggaagtttaaaatcaaagggctggctaagtagattttattccaaggcttcttctctcagtttataggcagctattatctcactgtgtcacatgacctcttctttatgcaagtgagggaagagagagatctctttctcttcgtcttcttgtaaggtcacccatcacataagataagattcactctcaggacctcatctgactttaattatctcctaaaagccctattttcaaatagagtcactttggggattaaagtttcaacatatgaatttgaggaagggacacaattaagttcatagcacaccttacttttcagtgtttctaatgtttagtgttctactaaatatatgcattttactgtcttttaaatttctctatatatttatagctgagagtgagttttaatgatttaacaaaaagtttaaaaggtcagagaataattgccatttttctattggttattaagatccctttgtacagtttcagtttgtgtggtcatttttacactctcagattgcctagcgaaggagagaccacttgggctgagtgctggtgactttgcagtgaggtgagcattctcaaacatggctaacaggagtagaaattaataaatgaaactcttcatttaggacaagttgactgaatgtaacagggaacggaaaaaattaccatttctggccttgtaattttactacttggattatgtcacctgtaaatagagacacagtcagatatttatataccagtatgtttatttttagcatcaaagattgctacattagctgaagaggtaatgtggcttcggacacaaacaaatagaaggcagacataaggacattttctcaaatacaaaacgaagattatgaattcagaacaagttcaaattgttcccagtatgtttgtgtgtgtgtgtgcatatatatatatatatatatatatattttttttttttttttttttttttttgagacagagtttttctcttgtcactgtgatggagtgcaatggtgcgatcttggctcactgcaacctccgcctctcgagttcaagcgattctcctgcctcagactttcgagtagctaggagtacagtcacctgccaccatgcccagctaatttttgtatttttagtaaagacagggtttcaccatgttggccaggctggtctcgacctcctgacctcggtgatccacctgcctcagcctcccaaagtgctgggatccctggtgtgagccaccgttctgtgagtttatgtatttttaaacaatgaacacagtttctgggatctgactcttaggactgcctagcaggtttcttgaccgtgtacaaatcagattgtcttattctccttcccgtaactatcaaaaggcttcttgattccatcaaaatgaatcccagattctctacagtggctgatagggtcttctgggagcagaccttgaccaaacatttaacttcctttcctactgcattgattttctttctgtttcttttcacctcagaggtttgccaccagttgtttctgtatttagaagacagcacccacattctcatggggttgactccttttataccttggggtctcagctcaactctcctctcttcctaaaaggctctcagcttcttctcctcaactccaatcactctatcatttgactctgttttattttcttcctaatcttgttctgttttaggaagagttgaccaggaatcagagtatgaaacaaagttctgagtgcaggaagcttactggagaaatgatccagggagcaggagaaatagataagcttgatgaacaaggaaataaagaaagtcaatataaggatgagttataggattggctgctgttaagggacactgtggtgctagaccctttgaaatgcatttctgagctattcatcttgaggatagagacacatttatctttatgtttccagcccccaggggtcagaagtagccccatggcattagctacctcacatttccaagaattaagcaacttcttgtaggtaccctgtgccatagtgtcttagataaatttgggtcaggaagcaagaggtacatgaagtggggcaaaatttcaccttcaaggaactcttgggtatattctatgacacagaaaatgaaaagcatgaaatgttggaacttgatctaacttcaaaaaggcatgagtcactgtaaggttgcaccagtatgaagctcatcaaaacttgggagaggccattatggtatcagtggttagagtgagagatggtacaaagaagttatttaaagtgctgtagaagaggcatccgatacatcatcagaaattatgtttgcatacagttgagtattgttcatctctaaatttcaggagaacatgactatcaaggatgactatatgagcagaaccttatattcctcgatttagcctgtgcccttgaaggatctaaagttattactggctaatagcatcttctggctcttagcaattccagaagtaaatcccacataatgaaatgtaaccccagtataaccgcctagggtttcaattcactgaggtcaaccaataggagtccaaaaaccacaatgggtgagactcagcaaaagcaagcaaacaatcagatttagacacctaattatttaacatgggaatatcagaaacaaaatacaaaattaccttatgaaatatttaaagaaataaaagatgaaataaaaatgagcaagcaataaggaagctatttaaaataatcagatatttaccaagtaaaagtctatttttgcatccagtatggccaactctttgatgttagaactgtgctagaaaaggcaaatacatggttcatgtatgtgaatccatacagaaaaaaattaattaattaaaaaatattaggctgaacagaccaataacaagtagcaagatcaaagtcctaataaaaaatctaccagtaatgaaaagctcaggacccaatgtcttcactgctaaattctaccaaacatttaaagaactaataccaatcctactcaaactattccaaaaaagtggaggaggagagaatacttccaaactcattctacaaggccattactactccaataccaaaaccagacaaagacacatcaaagaaacaaacaaacaaacactacaggccaacatccctgatgaatattaatgcaaaaaacctcaacaaaataatagaaaattcaattcaagaacacattaaaaaggtcattcatcatgaccaagtgggatttatgccacggatgcaagaatgattcaatatatgcaaatcaatcagtgtgatacatcatactaacaaaatgaagggcaaagaccatgtgatcatttcagttgatgctgaaaatttttttaaaaaattcaacatcctggcatgataaaaactataaaaatactgtttatagaaggaatatacctcagcataataaaagctgtattgacagactcatagctagtatcatactgaatggggaaagactgaaaccttttctgtaaaatggggaacacaacaagcatgtctactttcaccaatattattcaatacactactggaaatcctagctagagcaaacagacgagaaagatataaagggctttcaaaacccatttatgcctagtgttccattattggaacactaaacatgtgggagttatttttatcctactgctcaaggtcatcaccaaagtccgatttttcaaattcaaaaaattgcaacctcaagcataaatgggttaaaatggaagacttctacttatccttgtttgcaggttatgatcttacatttggaaaaaccctaaagactccatcaaaaaactgttagaactgataaacaaattcagtaaatttgtagcacacaaaatcaacataaaaaattagtagcatatctatatgctaatagtgaacaagatttggaaacaacctaagtgccaatcaacagacaaatggataaagacaatgtggtgcatatcagtaatggagtactattcagtcataaaaaacaatacgatagctaagacaattctaagcaaaaagaacaaagctgcaggcatcactcaacctgatttcaaactatactactaggctacagtaaccaaaacagcatggtactggtaccagaacaggcatatagaccaatggaacagaacagagacctcagaaacagcatcacatatctacaactatctgatcttcaacaagcctgacaaaaacaaggaatggggaaaggattccctatttaataagtggtgctgggaaaatgaggtagccatacacagaaaactgaaagtagacccctttcttacatcttttataaaaattaacacaagatatattaaagacttaaatgtaaaacccaaaaccataaaaaccctagaagaaaacctagacaataccattcaggacataggcatgggcaaagacttcatgatgaaaaccctaaaagcaattgcaacaaaagccaaaattaacaaatgggatataattaaactaaagagcttctgcacagccaagaaactagcatcagagtgatcaggcaacatacagaatgggagaaaatgtttgcaatctacccatctgacaaaggtctaatatccagattctacaaggaacttaaacaaatttacaagaaaaaagcaaccccatcaaaaagagggcaaaggatatgaacagaaacttctcaaaaggagacatttatccagccaacaaacatgaaaaaaaagctcaacatcactgatcactaaagaaatgcaaatcaaaaccacagtgagataccatctcacaccagtcaaaatgcgattattaaaaagtcaagaaacaatagatgctggcaaggctgtggagaatggttttacactgttggtgggagtgtaaattagttcaaccattgtggaagacaatgtggtgattcctcaaggatctagaaccagaaataccatttgacccagcaatcccattactgggtatctacccaaaggaatataaatcattctactatgaagacacatgcacatgtacgttcattgcagcactgtttacaatagcaaagacatggaaccaacccaaatgcccatcaattatagactggataaagaaaatgtggcacatatacaccatggaatactatgtagccataaagaagaatgagctcatgtcctttgcagggacatggatgaagctggaggccatcatcctcagcaaactaatacaggcacagaagaccaggaacctcatgttctcactcataagtgggagttgaacagagaacacatggacacagggaggggaacaacaaacaccagggcctgtcagggggtggagagcaaggggaagtagagcattaggacaaatagctaatgcatgcagggcttaaaacctagatgatgggttgatagatgcagcaaaccaccatagcacatatataccaacgtaataaacctgtatgttctacatacgtatccggaacttaaagtaaaataaaaacaaacacacaaaaacaatccgatcctgtcatttgcatcagtgtggatgggactggaggtcattacgttaaatgaaataggccaggcatggaaaggcaaactttgcatactctcacttattgtgggaggtaaaaattaaaataattgaactcatggagatagggagtaaagggatgattcccagtgcctgggaaaggtagtggtggtgcttggtggggggaatggggatggttaatggttacaaaaacatagttagaaagaatgaataagatctcatatttgatagcacaacagcatgactatagtcaataataatttaattatatatttaaaaataactaaaagagtataacaggattgtttgtcacacaaaggatcaatgctcaagttgatggatacccccatttgccctgatgtaatttttatgtactgaatgactgtatcaaaataactcatgtatacacttactatgtatctgaatttttttaatttaaaatattattagacacaaaaatcatttactaaaagtaaatctcaactcactaggaagatataattctaaatatgtatgtactttacaaaatagtctcaacctatataaagcaaaaattgctacaactacagaaagaaactgacaaatctaacatcacagtaggagatttacagaacttcatgctttactgaaaattctgtcagttatccatctcattagaattgcctgttttgttaatctttttaatagtgctgattccttaaaatgggctgagtctttgtctttggcctagatcatggtaagattttatgaaattatcacattggtttaagaagaatgtggcttatctagttgataggcacaagacataactctaaacatgtatgtacttcaaaaaatagtcttctatagattcaggcttattaattatatcattcaaaccttgtataacttagctttataaatttcttttttcaaaccaagaaaacaccagattttgatggctttataggatattctacaaaactttatggaacaaatcattgcaattttataaaaattctttcacaagatacaaaaaagggacactatcatataatttcattctatgatccaaaatggaaataaggagtgatcttactcataaatataaatgcaaaggtattaccccaaatattagaaaaataaaattcagcaatctgttttagaaaaataaagttcagcaatctgcacaaagggtaatgtgccaaaactaagctgaatttattccaaaaattcacaagtgagttaaaaagtttattcatgtaatttccacattaatgtatttaaggatgaaaacaacatgatttcaacagatgtcagacaagcacttaacaaactccacatttatttgtgatgaaacttttagcaaactatgaataaaaggaaattcctttaatctattaaaaagtaccaaataactcctacagtaaacataattcttaatagtaaaacattaaaaacattatctttaaaacttcaaacaaggcaaggatgcttatttttactactgctatccaacattatggtgcaggtcccagccagtgcagcatggaaagaaagaggaaaaaatgtaaaatatggaaaggaaaaacaccatgcttttatcatttttttggcatgtgattgtccatacagaaaattgaaagatctctctctctctctctctctctctatatatatatatacatatatataagatatatatggtagatatatatatatgtatttctataaaatgtagatatctatatatatacatgtatatatctatatatatgtcaaaataatagagggtagagaggtggatggttgtaacaccagcagtccaaaattgcatttatatacactaaccaaaaatttatgaaacataattttgagaaggtaatattatattagcagcaaagtatgtatggtacttaggaataaatttagaagtaaatgtgcaaaacgtggagaaatatagtactttattactttatttaaaaatataaacaataaaaattattattttatgaatacaaaggcttaatactgtaaagatattaattcttccctgttgatctagagattaaatgaatttttaatcacaatccagacatttaagaaatgatttataagctgattttatattttaatggaagatcaaatgaccaggaatagtcaagagactcctgaaaaaacaaaacaaaacaaaacaaagggaggaaggtgaaaggtctagctttaccacataagaacaactataataaagttacaataatttgcccagagtagtgtggtaggcaaattggccactgaaacagactcaagatcctaaaaagaaacccacacttataaggcaccttaatatgtgatggttactttgtgaattaataaaagaaaaatgaacattttagtaagcggtattggaaaaatttattaccccaaaacaaacaaacaaaaaaacccaaacaataaaatcaataaaattaaatccctgcctcacatccataagcaaagtcagtatctgataaattaaaaacatttaaatgtgaagacaagtcttcaaaacttcagaaggtaatatacagggtatcttcacagctttaagatgtaaaaaatttttacagcacaaaaattcctaaccattgtatttgttttctgtggctgctataacaaattaccacaaactaggtggcttacaacatagaaatttcttctctcacatttctggaggctgcaagtcagaggtcatggtgtcagcaggctcatgctccctctgaatatctagggaagtccttccttgcctctgcagcttctggtgtttgctggcagtctttagcattccttggcttacagctgcaccattccaatgtcttctttctttgtcacatggctgtcttccctgtgtctcctctgtctctgtgtctgaattcctctcttcttataagagaacaacagtgttttgatttggggtccaccctaattccgtgtgacctgtatcaaccctattccaaataaggtcacatccacggattctggtggacgtgaattttggggggacactattcaaactagtataagcattgtactagtttgtttttatgctgctaataaagacatacccgagactgggaagaaaaagaggcttaattggacttatagttccacatggctggggaggagtcaaaattatgatgggaggaaaaatgcactttttacatgacagcggcaagagaaaatgaggaagatgaaaaagcagaaagtcctgataaaaccgtcaggtctcatgaaacttattcactaccatgagaacagtatgggggacactgcccccatgattcaaattatttcccactaggtccctcccacaacatgtgggaattatgggagtacaattcaagatgagatttgggtggggacacagagccaaaccatatcaaccattaaggaaaagattgataaatcctttcactatttaccatgaagagaataaaaagacaagccataaactgagagagaatattaatgttatatatataatgaaaaatttatgtgaatatactgtataaacagacacataactgacatgactcaataaggaagataatgcaataggaaaattggcaagggtcatcaacaagcagttcacagaagagaaaacatgtatgatgaattaccttatgaaaatgtgctaagcctttgtagtaagcagagaaatggaaattaagaacacaataaaatatttttttactttccttaaattatggggtctgacaataacaaggatggctgaagatttagcataatgggaaatctcatgcattactagtgagattgttcatagaagcattatttatgatggcaaaacaataaaagcaaaccaacattcattggtaagataactgatgtattgtgatatattcattaactgtactatttttacacattaataaaaaataaattaactatagatacaaatgacagcacagttgagcaaaactgtttgatacagacatatatgatcaatctatccttaacaaaaagcaagagaatgacaaatataaaatgcaagatagtggttaccttcagggaggagtcaggaagctgagccagagaaggatcatgtgaggatattggtaatagtctagttctttggtggtagatttttatgtgcttcttttattaggcattaccatgtggatgtgtgctatgaatggttgtgtatagcaaatattccatgatataaataaaaaatatattttaaatgtcatgatatgggaacccagatatattcaacactctgaaactagccccattttaattgcagtattgatgaacaaggatttaagtcgtcaatagaatgtactgacaaaacttgtgctcaaatctggactcgaccattgactaactgtgggatattggtaaattttcttaatttctctttgctttggttttctcatctataaaactaggataaaaatggaccttgctttacagggttgttatgaaaatcatataaaacaatggggataaagttcttcataacaattgcttgaacatgcagtaagcacctagtgaatgtgatgtatttagattagacagaggcctgaaatgtacttaggcaagtgctgtcttgcccatctgtcattgccctgaaaaggccttgctcccaggtagctgctgccccttttgcctgggttctagaatgaacacacatgagcccagcccgcactgaggatctaagcccaagtgagcttgcagtttgaaacagagctgcctgcctgagcccagactcaattgacaaatccccagctgacatgctggttgaagaattgagaataaataattgtgttaagcctatgagtcttagagcattttgtttataaaagtagttgaccaatacatgagctgctattattgttataataattattatttatattaaagataacaaagatagttgctcttgggtctgcaatgtttatctcatgcccactggttgtaaataaactgattgtttaatgccttaaaacatggagaactttccatttctatcttgagcaactgtcacaagcataaatggcttactcacatcagcttcatccctcctatatctccagaacacgctgggttgtatcagctctgcttcagcacacactgccattgtgaaaaagacctgagcacagaggagagacacgctatccctagtttagtggagtcagttgtgtaactggatgttccacatcaatattatgaatgcctctttttgttgttagaacattgtacagtccataaaccactcattcacgtattgtcctattgatctgcactgcaatcttcccgatagccatggtcaggattatgctgcctcctgtgtaataaaaagccctaatctttcagcagttatagtgacttgacaaaggccacaaagcttgtacagtacaaaaggactcaaatctacaacttctaatgccaaaccctggcttactttcactgcctcatggatgcctcttaatgctcacaattttctttctcaagaatagacaattttcaatgaattgggtcagcaacaggttgggccagtctcttatgtgaccctggtgtcacaggaaatgtgctaccacatacatagcggcattctgtcattcctctgtcagacactggaactcatacaaatacacaaattctaaaacattgacagtggcttctggaactcttagtctttgctggtttctcaaactgtttttggttagaagattcgaaggttggggagcagatgaagtagggacagatccttatctaaggtacttggaaatatctgaacccaaactatccaatgcattaatacaagattacagaatcaagaaaccaaggcctgtttccatagactcgtttgtaaattcagatatcatgtgaaataaattgacaaatgaatttaatgtgttttctttaaaacttctgcacaaccagtaagaacataagggaagctttccaaagtattgcctcggtttatgacacaagatgtccttgtgtgtaaaattcttttaaatagttgcctagatttttaataatacactttatttttatcaaataaagctgtgagtttctgaacacttcctctttgggagaaaactgggttcaataatttagcatcggagtaaagcactgggtatttgtctgtctgggttataatctcatttccaccacctactggttgtgtgactttggacaagatgcttcagatttctaaacctcaagtttctcatctataaattgggacaattaataagacttttctcgtaggtttttatgaggattaaactaggcaattcatatacagtgcttagaaaaacagctggtatagttgaaggtcaaatcctagcaatttagtagtaattgttcctcaaattattaggaattagctggacatgatttttggcaggtgatttcatttttgtcattgcttcatcagagcgctatagtgtgtttattgctttatctgagtattatgtgatggttaaagaagttgtgcttaaatcagatttttgaggtttcagattgcatgcgcaagaaacggaacaattttagtctctagtgtgttattttaaaaaatgctgaaaaataagagaatccaccccataggatcattcataagataaagtgagaaaatggatatggatggcaagcccttagaagaatgccttgaacacgccgattccatagtgacaaaacaacagcaagggagttagaataaagacccaaagtctgttatctttgtctccattggtctgaaggtgttgactctgtaaacctctaacaagaatattttaaactcaagtcactgacatctttgtgctgttagttgccagtccctgggttgtcagtctctggctcgtgttgggttgctccacctgcccttggctttgggccctttctccctaaaggggcatgtttggagctgagccagagtccatatactcacagtgggcaccacggctcacagctgctgccagtgtgttgcccagaacacactctccttgagagagcttctccaagttgtcatcccagtagtggttggagtagaagatatccctttttccagcattaggctacatttctgacaattccaaaaacccatttccgcacagccctggtgccagcccagccagaatttatcaactccaatcccttatccattcctgcaatacttctatctttcaccccaggctgtaaaaatccaggcctatccatatttaaaggtctagtcagaacatttcttgcttcacagctaatcagaaattctctcttttattgaaacctctcatcacactttaaaaagaataaatctaagctctctgtcatgacctgaaagtctttttctgcctctctgattctatttccttcttcatttgtgttcttcagtcacacaaatcctttgtatgttctttggactttccaagttcattatctagtgtagcatttgctgtttaccatgcttggaaaacttgcttccaaaatcatcgcttggttgggtgtatttttttcagttttgaatcctttcccctccatcaaacaacaacaacaacaacaacaacaacaacagcacaactcactttccagtcaatcttgactggggttcttgactaggggtgctgcctccaccctcaactgggggacattaggcaatctctggagacattcttaattttcacaacttcttttcaacatagtactagaagcactatcaggagcaattagacaagaaaaataaatgaaggatatctaaattggaaaagaaaaagtaaaattgtctctatttgcagatgacatgatcctatatatagaaaaccccaaagactccaccaaaaaacttctatatctaataaatgaattcattaaagttgtgaaacataaaatcaacatacaaaaaaatccatgacatttctatttgcaaatatcaacctacctgaaaaagaaatcaagaaacactcccatcactcccatttatgatagtatcaaaaagacttcaaaataaatttaactgagatgaaagacctataaactggatactataaaacattgatgttgttttaaatcaacaatatatactctctgctttaccttgactaataaagataaagctttttaaaaagcttttaaaaaactagtgaattcagatttttctctcatgaacctatgcctgactttactctcaccaagaatgaatgctaactacaatttacttctttagctgtatgcttttccaaaattctttaaacactttctagcatattctaacataaaatcatatattcttatttggaagaacactttgtatttgtgataaaccagtctagaataaatgaattgttattaatccaactaatgacagtaactaattaattcacctgtttcttctaacaatttcctgataaaatgttttcttatctatctgttttttaacacaaatgttgatataatgatttactatgataatatagttaacacaactttttccttgtatatatttttttatacctcctggaaatataaacctatgttcttcatgcttatctcctttatctcttgacaattttttagaaccaaagatctgattttggtgactaagtgaaataaaaagaaaccattaagcaaatttaataataataataattattattattattatcattatattttgagacggagtcttgctctgtcacccaggctgtagtgcagtggcacgatctcagctcactgcaacctctgcctcctgggttcaagggattctcctggctcagcctcccagatagctgggacaggcatgtgccaccatgcctggctaacttttgtatttttaatagagatggggtttcaccatgttggccaggctggtctcgaactcctgatctcaggtgatctgcccaccttggccttctaaagtgctgggattacacgtgtgagacaccgtgtccagccaaatttaatattatgtaactgttggtgattctacttttaatcattttataatttacttatttaggcaaagtcctattttttagaaatcttttcctatagaaatgtttttaatatagattttagttcaaaaagagcaacaatgctgacaatataatcatcatcaacattaactcaatagcaattatagttaccattccttatgtcacatccttctctacaaattcaatgaaaatattttatttaatcctcaaaacaacagtggagagaagacaggacaatttggagaaaatgagatatatgaattttaagtgacttatgcaaactaaggcttgatcctaggccttctgtctctgccaagtattcctttcctcccttgtgcaatcccaacgcttgtggaacccaaacttatcacctgtaacaagcattactttctatacaaactggagatacctcattgaaacaattcttgagtctcaaaagagaagtaaatctatgattttcatggattaacctattgttgtatcttaggcattagtcacagttttgctatacctagatttttgctatccaacatggtagtcactaattacatgtggctgttgagcatttgaaatgtgagtagtctgaattgagatgtggtgtaagtatcaaatacatactggatttcaaaaacttagtataagaagaagaatgtactacaaatcttctgtacagcaaagaaaacaatcaacagaggaagtgaaaatccatggaatgggagaatacatttgtaaaccatgtgtctgataatgagctaatatccaaaatatgcaaggaacttaagcaactcaatagcaagcaaacaaataatctgattaaaatggacaagggacctgaatagtcatttctcaaaaggagacatacaagtggccaaaaagtatatgaaaaaatattcaacatcactaatcaccagagaaatgcaaatcaaaatcacaactgttagaatggctattatcaaaatggcaaaagttaagaagcggtggtgaggttgtaaagaaaaggaaacccttgcatactgttgttgataatgtaaattactatagcacttatggaaaacaatatggaggtttctcaaaaacttaaaaatagaactatcatattatacagcaatcgtactactgggtatacatccaaaggaaatgaaatcagcatgccaaagagatacctgcactcccatgttcatcaaagcatttttcacaatagccaaagtatggaatcaacctaagtgtctatcagtggatgaatggctaaagaaaatgtggtacacatacacaatggaatactcttcaaccatacaaaagaaggaaattctgtcatctgtgacaacataaatgaacctggaggacattaggttaagtgaaataacctagcacagaaagacaaatatcacatgatctcacttgtatatgaaatctaaaaaagttgagctcatagaagcagacagtagaatggtggtcaccaggttggagggtgagattacggggatgttgattaaaagacaaaaagttccagtaagataggaggaataagttcaagagatctgttgtataacatggtgactacagttaatagcaatgtatttcatctttgaaaatcactgagatagtagattttgtgttctcaccacaaaaaataagtatgtgaggtaatgcttatgttaattagtatgatttagccattccataatatatacaaacatttcaaaacatcatgttgtacagaattaacatacaatttttatttctcaattataaattaacttattttatttattttttgagatggagtctcattctgttgcccaggctggagtgctgtggtgagatcttggctcacttcaacctctgcctcctaagttcaagtgattctcctgcttcagcctcccaagtagctgggactataggcgcatgacaccacatctagctaatttttgtatttttagtagagatgagatttcaccatgttggccaagctggtctggaactcctggcctcaagtgatctgcccacctctgcctcccaaagtgctaggattacaggttcacaggtgtgaaccaccgtgcccagccaagcaattaatttttaaaaaggaatgtaaaatatctcattaataatttttaatattcattatacatggaaatgaaaatattttggatgtaatgtgtttaacataccattataactaattttatctgtttttaaacattcttataatatgggttactagagaatatggaataatatacatggttcacatgcatgcctcacattctgtttttattggacagctctgccctagagtttttaatctttcttgggcatagttcctgattttactctttatttaatatgttttccctttcaaaatgattgaaacttttctgccagtacttaagcctcattatcacataatcatctgtttatttcctatatttggcacttgacactttaatctagaccctgttatgctaaacacataacttaaaaaaatttataagacctttttagatattcaaaattactttcaagttagaatttcaagtgtattcttaagaaaaagaaaaggacaaagtataaaggcagagggagagggcatagcacaagtcaattttatcctgcagggagagcacttaaagtaaaattttatcgaataattacactgggaaattctgcttgagtttccccatgtactgtgtgcctatgtgtgcgtattagagtctttcaaggatcagatgagttaataagcataaaacacacagaacagtgtttgccatcgaataaacaacaaatactagcttttattttattataaaatttgattggagatacctcacagatcaatatatttccaaatgatctatggccacaatagaacttaatagctaatatgggagtgattattaataaaagatagttgtaacatagaaataataaatatttgaagtgatgcttgccctaaatcctctgatgctttccctaaatcctctgagttgaacattgcacatatgcatgtaacaaattatcacatggaccccataaataggtataaatatgtatcactaaaaaataaaataatattctctccatcccatcagtcactctcctctacctgccttatccaacatcacagccctttcccccacctgacatgtttctatacatttgtttgtcattggtctgcccaccagaatgtaagctgcctgagggcaggatctttgttttgcttcttgttgaatcctctgagcctagaataacacctgacagagtaggtagtcccataggggtctgttaaataaactgtggacaaataaaaaaaatgtttaaagagagttgtagaaacatatttcaatgcaattctctctttctgtatcctttcacctaactatcccttcaattttacaactatgcactttatatttctattgttcttagtattgcaaaattgtaccactgaaggggaaataatacagtattatctagtcaaacttccttacttaacagatgaaaaagatgccacccaaagaagttaagtaacaggtcttgttctaaaatagttatttaagagatggaagagtgatagtggcattttatcaagcaattgccatcagccagcactatatacaagctttgaagacagtatctcatttagtccccataacaagtgattaagagaaatactgcttcttcttgcatgacacgagtgggaaaatggaaactggaagggattgggttagttgtctaaggttgcacatcaggcaggctaagagttggggtataaactggagtttgattccaaagttgtgggcttcacactgtgtttttgctgtttttcttactagttttgttttgtttttaaagtaaagtgatacagtaagggaattacaaagtaaccgttcagcctctcttttggttagtcttggatgaatgtgaatttaaggcgtctgtcagatctagactctcgttggtagcaaatgccaagaaggaaaggaggcagcccatttcatggttataaagcccagagcaaagaccccagggaggcccttgatgtgttcagtttcagtgggaataaacataaaggatgaggaattaactgagttatgacggacaaaatatatagacactcttccttgagggacatgtcaattgatttaaggagcaaacagggagagtatgtgaaatggactgtaaaaatgactctgtgcttcttctctgtctagagatatcagagattaacttttctctcacaacagaatcatcaagttatcaaacacatttaagagtctttattctgacagaaccagtattaataaattaaaataactttaaaattgggtaaaagaaagttgaaattatgtaattgcttgttcattgaatgaaaaaaatgatttcttatttattattaagttgttttaaagtttgtcttaagtaatttacctaaagtagtatgagatctatggggcttaatgttttgaacagtgaaatttgatttggaaatgatatgaattccttggatctttcttgctggaaaataaaacactcacaaacatataaatcacccaaccctaaactgagggagatagaggtaaaatggaagatgaacgaagtttattcaaacccaaatattgtttctaaattactggataatatagttccagaaaattcacatgaaaaaaggccactcctggtaagaatgagtatattaatttcctgttgttactgtaacaaattaccccaaatttagtggtataaaaaaaggactggttctattacagttctgtataccagaagtctcactgggctaaaaatcaagatgccaacagggctacgttcctcctggaggcttcagaggataatctatttccttgaggttgccagcttctggaggctgcctgcattccatgtcttctggccccttcctccaccttaaaggccagcagaatagcatcttcaaatctctccctctaactttcacactctcttctgccttccttttccatttatcagaacctggaggcagtcatccttcatctcaaagtcacaatctctttgtgctgtcttctctgtgttcaacttttccccattcttttcttcccaggtcctctgtcatcaagtcttggtagtcacaggtcctgctttagactagcattgttctcatttctataacttaccattttattggactcaattatcacctaaggggcattcttcagcaggaaacacatttatctgagataaagtaagttttgtcatctgtcctcttgagactttggttattttacaatcttgcaacaacgctgctagatccttcttctgcatgatagttgtgtgtcatcactggtattgttccttccagcctctccatgaaatttctattattcagaattacctggcttaattctagttctccacttccattttggcatgtgtatagatgcccacaatatctgtgtgcacacagatacacatcatatcttggatgcctactgatgctcacaatatatgggtatgtgtatatacacatatatacacatacgtatatatgcatataactatatgtaattcatggatgtaagtatttagcaagaacacactcacttaagagaagaataatatccagtacttgtgctgtatgttcagaaagatttgaagatgaattacatggaaccagctatgatggaattatgtagatagtttcctcaaaagaggaccattttctgtgtataaatactaaactttggtctctgggacccagacatgtctcactgaaagaaggtaaatcttattacaaaatcatgggaatgtttaatcaccaggagtcagcttgtagaagaattgctgtcttccgtttaaatgaatcatgactggtgagttaatggtagacgctagatgttattttaccacatattttatcacttaatataaaccacattgtgaaagaaataagcctatcagcattatattcagaccaaataaatggtaatctttcccactgaagtttggtaaataatttaataaatcttctactagaatctcatgaaatttcaaataaaccagtagactttcagtttagctgtttagtactcataatgaatccttaatgtctaacagcatctactgtttacatttgcctgaggtctctaaaacattatgagatgaaacgatttttttctgttccttggtgtatggctgtcatagaattaaagtgtttcatgaatttcatatttgagtgaatgatttccgttcttcagcctcttgtgggaaagaagaaataggtggcgcttcatttaatagtatactgtcttgtctagattgaatttgttatgaattgcatggttctcaattgtactctcatgcgtccttaaaacaaaccacaaattctatgggactcatattttgttctttgctgaacactaagagtatataaatgatgatttaagagcgatgtaactgaagttggtataaggctacaaacagtatgttaattttccttagtaacataaaagaaagcttgttttgaatatccttaaaagtttaataagagttcctttcaaggcactatagaaatacagctccacagaaaaataagtatgtatccattagcttttgctaaaatgtacccacatttccaattacaaaattcttgtaaagccaataatttcctccttttagaatcacttaaaacaagtgggaagaattatattgttattcaaacagggaacatttgtgtatatagaatggatttccgtctaaacttaggagattgccaaacttaaaaattattccatttgaacgctttggaaaatttaacaggagtcaaaagagcacagaggagggagttaactggctgagctctgtggatcaattgatcaataaccttttctgtgaactcagatcaccaggttcattcagcaaatctctactgaggtcctattagggctagactttgttctgggtactaaggatgcaatactggccatgttagataatgtctctgactcagtggtatttaccttcttctgttgaagaaacagacaacactcataaataaacactcataaataaattgacatgtaatatactgttagatgattacttttaagtgctaccaggaaaaataaaaaaagggtagggctggaaatgataggagtgtgactgaatgccctgggtttaattttcctcacaagctttgttatttcaatgagcatgagagtttaaagcagcttctaaaaacacgtaaggtacagaataattacataaatattagagggagtttggtataaggttagaaaaaactattacgttccagggttaaatttaatcacagacctatagactttaaagtctggtatagttgctagaaagaggccgtagacttgaccctaaacctcctataagccaaagcttatatcacatccaagtccatcggcatttatgtctacaatttctagctgtctacttttcctttctcttctattttattcaatacttttgtagttttaagtaacatagaaaagatttttgcgacagcgtatatgtcagtttctcagtatgattttatatcttagaaaattaacttagctacttaactaatagaatgaaattgaaaacagtttcacaaaacctctttagttaagccataactgaaactcaaatcacggagacatataccaagaacagagaagaaagtagtaataatctaggtggataaatattttaattgccaggtatcagtttttaacagtttggttggcatcattaagaagatttcatgtaatttcacctaccaggactccttttaccacacccaccacatttacccacttagcctgcctaaacaaaattaaataaattagaataaaaatgcttgttgtgacactatataactttagccattatttttcggcagtttcttttccattctcttcttgtttctccattctctctaccttggtattcaaaacctttattggaagctgagagagcagagggtacgggagtcattagttaccacgaaagagaagtgaagtctctgcatgaggcacacacatctttggtgtccaagtggttctgaagtcatgaattgcaaacacctgcctctgttttagagccctgcaatggtgacacctagcaggagagaaaaattctcttttaagaaataattccctttaatgtgaatttcttttcagatacatgtccacaaacacttgttttttatgagtggatcttgtgacatagagtaggtgtgtttcttgaaagttcaatagccatgagacctttctaacttgagttttgtttacccagggaatttaattcgattttcagaaaattttttatttgtgacttgctggtgtactgatcattgtttaagagaatcataaagccagtatatggtgaaagacttatgtatgtatgtataaatttaatgtaaaatatttctgaaaagtatagtgttatatccaaatagttctttagttggcagcactaaatgagataattgtatgtgtatttctgctgagaaagcagatttttcatttggaccctctctaatcctgaaaaagtacacttatttttttcttactacattgagattgttcttcttttctgttgtcattatatgttaaataaaggagttgaagaattggtgggggtgggggtggggagagaatcataaaccataatgaaataagtatatccttaaggctactggtccaggaatattctctagggttgcccacgtgtgaagcagcttgtggcaaatcaatgcctgagattcaaggtgtcttctctatgactttttgtttgagcatgtatttggaacatagtgttagttctcttggtatagtaaagtgttatgacttaatctgtccaatcattagtttgattgtcataaaatggggataaaaatattgcctgtggcattaagtggtggcaagacccaatgaaggatgcacgcaaaacacacggtacagtgttgctcaacgtcagcgcccaacagtgctggctgtcatgatatggtgatgatagcttttctctctcagttgaaaaggcatagatttctctttgtacctaagttctcatgctttgaagaatagcgtcctttctcagtgatgaccttcaattttacatacataatttagcagattttatttgtgtgtgtatgtggtctacctggattacacaccagctgctgatgtgatggagggttcctatgatggtaaggtcatcccacatcaaatgcccccagtatctttctgctcttctgcctcaagacttcttcccaagccatgagtagtgttcatatgcaaagaagataatacccagggtgaatcccaatcactggaggatgagagtctatggataaatgtcccagtctctctggcttttgaagggaccattctgaaacacgttcgttatggttttagacattccccagtgggaatgagcctagttgcttatagtcatcaccagttcagtgatgcagctgtcttggctttttctccttccttccgtcctgccacccagaattatctctcaaataaattactctagactttcagatctttgtgaaggaatccaacttgatatgaagaacataacctatattatcactcaaatcatcacatatattctctccaaaattggtgaaaattcatccagacatttttcatgtgatgcagtaacagtagacaagctgacagaagtctaattttatttatatagcccatccataaacctaaatactgtcccttgaaattatttatgggcctctgcatgtcaaatgtattgttagtaaaacaaaaacaaaaagaaaaaaggccacttagatatcctaagggtgcttactacttaatccttttaatctttccatggaagaaaaaaaaatcctatttatagtgtcaattatatcctcacttgtctattttttagtttagggcattgggacaactcttgtgattcatgaccacttctgttcatcatttcaatgcaagtgatcagaaataaagagtatcttgatttagagtctaaaaggtcaaattgcagttgtctaaggcccgtcaggaaaaccagtttgtgttgttttattagcattacagcatatcccatgcctgtctttctgtctgtctgtcttggtctattataaacacttaacttttttcttgtaggggcatgcataaggttagtattaggttgctgcaaaaattattgcggtttttgccattgaaagtaatggcaaaaaccgcaataacttttgcaccaacctaatagttatttttcagaaagaaaactaattaagatgaggactcatgtgacctgatactctccttatggacatttagcatgcaacaataatccctgaagggataaatcttaaccaatatgactttaatcatgcaaactaatagctttcaggttggattcagctagaagacatgttgatttggtccacatagtgataacaaggtttcacatttgaattgcttgtgatttaaagatccaggtgttttaggctgggcgcggtggctcacacctgtaatcctagcactttgggaggccgaggcaggcggatcacaaggtcaggagttcgagaccagccaggccaacatggtaaaaccccatctctactaaaaatacaaaaattagctgggcgtggtggcgcgagtctgtagtcccagctacgtgggaagctgaggcaggagaagtgcttgaacctgggaggtggaggttgcagtgagctgagattgcatcattgcactctagctccggacgacagagcaagactccatctcaagaaaaaaagaaatctaggtgttttaaataccaacaacaacaatgtgtattttgagcttctgaaatggattgtgtaacaaacctgggtctctattcttgcattgcatgcatagcacagcctggagctgagtaccagttgcttattatttggaggttgccactaccccctcctagcttgcaccttcttggtccttggctttgttttctttgccttttacctgcttcactcattgatgctactagcctagcctcgaaaggaatttgaattttaatctcagtgttaatatcctagaagacatgcattaaaataactttcctcttttaaagccaaaataaatatagggcaaaatagtacaatttaaattagttaattcttgaatttactgagcccttcatgacttgacccaaataaaagtgaagggtccgaactcccttagtttactgatgtggaaactgagaaacagagaagttttttttttttttttctgaaacacaatatttgtacattgttataggatatatttgatatgtctttacatgcatagactgtacaatgatccagtcagggtatgtagggtatttatcacttcaagtatttatcatttctatgttttgtgaatgttttgagtattctcttttagctattttgaaatatacaatacttcgttgttaactatagtcaccctatgctgctatcaaacattaaaaattactccttctaactatatatttgtagctattaatcagcctctgtttttcaccccccacccatacacccttcccagcctctggtatctatcattctactctctacctccatgagatcaacttagagaaattaagttttgcttatagtcacatcactaacgatacagtatgtctgctctgaagtggtctaagtaagacttggaagatgcttcactttttatgttgaagtagaaaggtcctaagctatgtcttccatgaagattttggttatttaaacaaaatatcctttttttttgaaaaactaaggtatttgtaaaacccaaattataaaattttgaattcctttcaaacaggcaagacctaaaaccatgatgtttttgaaggggtctgagtagattttatgagcgtattgccaagatgatagatcaatgggaaggtgcgagcacacacagaatgaaagggaaatgtggtaatagaaatcaaatactttcaaaaagcttgaatgcattgttctcttctaaatatcccttttcctgtcattattaatcttggtattttgctttattcttcatatttgggaatttcttttactggaaaactgggttttatataaaaagataatatatattctattttaggaccttcttaaaggtcaccctgtgaatgatgtgagaactttaccagagcatgcacattagagtcctcattagctactcaaacaaaagctcttaaaattcacaggattctgagttggtgtgagggtggaatgaaaagacccttttttctccttcaaaagcaagccaggcaatcaactccaggggatgcctacagggcccattaaaaatttcaagatgtgacatgagcttgattgctaaattggcgacacatggaggggaagccagtgcgcctcagaagcaatataatgcctatgaaataaatgttcttctgtaagcatgccaagcttttaaggcaccagggaagtcaaatctcttatttacatattagttttctgtgaacaaacccaattgctcctctctgctcccgaaatactctgggtcacaggcaacgcatacttgctcatgtctactttttagtagatccttcacattatgcactttttgttgcaataatctcacaactcgactgtgcctccactcttcatcccttacagtctattctcaacccaaatagtttcctgctgaaaaggaagtcacattgtgttgctcctctgctctaaccctcagaaatattttagccacctcagaacaaaggcctacgtccttaggatggcttacagcagtggttcccaaagtgtggtccctggatctgcaagatcagtatcccctgggaagctgttagacattcattgtctcaggccctgccccagatctgctgaaccagaaacactgagggtgagctgagcccagaaatcagtattttaacaagtcacctgggtaattatgatgccgagtttcagtttgaacactgctgtgttagaagaccattggtatttgtgtcacatttaccctttcgcttcattgactgctcttcttctcacactaccccagccactctgacctctgtgcttagtacatgcctacctgagggacttaggattttttattccctctcccccagatagctacatgctctgaagtctcttgtccctgaataatgatgtctctgctcatacacctgtttgttcattcatttattcaacaaatgtttgcatatctaaatgttgggctctaggctacaagcttgggttgtaagactaggtctctgaactttgggtatttgcactgtaaaaatgggttaaatataagcgatgaccattgcatcacagccattcttttgatttggcaaggactgcttgagttatttttatacctaccctcaccaacttcaggtcttttctcagatgccatcctcacagatgaggcctccttgcccactgtattaagcttcctagggctgctgttacaagtgccaccaaccacaggtcttaggaaacaagagatatttcttctcccacagttctgaaggctagaaaaatccaggtgccagcagggctgtactccctctgagactctaggtagaatccttcctttcctcttcctagcttctggtgatagccagacatccttggtgttccttggcttgtctctgtatccttctagtctctgcctctgtggtcgtggtgctctcccagtgtgtcttcaccctatcttcttagaaggacaccagtcattttggtttcagagcccactctactccagtatagccttatcatagctagctacatcttcaacaaatctgtttccaaatatcacattctgaggcactggaaaataggatgtcaataaacgttttcttaatgggggcgcacatgtcacctataattcccaccctatttaaaattgtaccttgccctccgcgtggcatactccgcttcttctgtgctctgtttcttttcttgctgcttgtgacctcccaacacactctatgttttacttctctatttggcttcctgtcaggctccctccactggaatttaagtttcataagggcaaggattcttgtccctttcattttcatacccacaaaatccatagcttttagaatatacctggcacacagtggctccatatatatttgttgaatgaatgaaaatgatagatcactaacaatatcatttagttgttcagaagtctgattaatttaaagcacaaaaagcactctctattttttaatttttaattttttatgcccgggaggctaagtacagagagagtattatgacagtgccacctgagaaaagttaaatttattctaaaataaatggtaagcttcttggtggacgagggttttctttttttgttggtttttttttttttttttttttttttgaggcggagtctggctctgtcgcccaggctggagtgcggtggtgcaatctcggctcactgcaagctccccctcccgggttcatgccattctcctgcctcagcctcctgagtagctgggactacaggcgcccaccaccacgcccggctaatttttttgtgtttttaatagagacggggtttcaccgtgttagccaggatggtctcgagcacctgaccccgtgatccacctgcctctgcctcccaaagtgctgggattagaggcgtgagccaccacgctggacgggctttctatcagggaaagacccaagggaagttttgtttctggggatatttccggataactgaactggcactgagggatcaggaaagaactggtatcagaagtatcattggtcaaagcaagacagagtaaaaggctctcccattgcagtttcttgtccctgggtaatgaagtctctgttcatacacttgttcatttattcaacaaatatgtgtatatctaaatgttgaactctgtgctacaagcttgggatataagactaggtctgtgatcttctggaatttccccggtagaaagaggttcaatataagtgatgatagccactcttcatttggcaaggactgcttgaactatctctgtacctaccccaaagagaatcagcttctttttacccagtctaggcacaaaataatacagatatttagtggccaagtgggaagccaccaaaacggaggactggattggaatttcaaaggtaagtctgctattgatcagtaaggatgctagagtcagtgctcaagcatcctgctgagccatggaattaaatgaaggtgctgtttagtgaaggttagaaccttatacccaagtttgcatttctgttctgctatttatgagacgtatgacgtcggaaaaggtacctaacctatctgaggctgttttctcatctataaaatagcattaatctttcagtattgtgtgattaacacagataaaaaaatataaggtttagcacagtgggaggtgcacagtaagctctcaataagttggtattcaagagaaacataaatccagatggcatacttaagagtttggtggatcttggcttctctttcagggcatcatgggacagaaaaaaatggagttatgaaaacaatgtgagccagattctggaaatgggaacacccacacgaatcaagaggcagacaatggtgtcaggaacataggaaaaattgcaaacttctcatgtatttatttttagggaggttgcctacgttttatcagttatgaatctcggatggcaaatttaaggcaagtttcataaaacactttgggaaagttaaccataatattaaagcatgaggtttcatcccagtattgttaaaattaggcagaatggcttgggaggccgttctctttagcagctcgcttaaccatgctgcttagaaaagatggcagtgaattgaaactgaaaggcaaactgtgctctcaccatctgtcttgaaagaagtatgatatggttgtcattcagactgtttggaagggaaaaccatttataagtttctccagccctggattgagcactctggacagagttggatccaaactataaaaaaattcttcctaaggttatttccaaggcttccatttcaatagcaatgctttcataatcaggcttaagccatccattgacttaaattactttatgagactggattaattaaaatgctcaagataagaaacccccatctatctccctttcctacttatcctgttcttcccccacggatcatcaaaatttggatagagtgttgagggctactcaaatggtcaggaaataacaactgtgattaacatggtggctttagaaaagttgcatctgtagcaacaatcagattttacactaggagaacagttgcacatgattaaaaattctgaacctacacaaagtgtcattttctagagcaaaaatgtccttgtgctttagagactgagacaaggaaggaatgaagtccacatcccctcctgccccctttgctagactcttcagcatgctgtcaaggtgtcagtttgctggcccacttctgactaaacagaaggatcttttcatacaggtaaggtatttcatatgcatttttccactctggaaacatgagcggtggcctctttaggtcagatatataggtctacattatggatggcacacagtgcctgcttttataagctgattgccgatctgtccttgcttaccctagagcagagaagatgttcaatccaaataagcatctttcagctaaatgacctttgctcagccttactctctttagaactttacctgtctacagcactggatgaaactaggtttaatatctattcagtcattccttaagcattagatgtttacatttcaagcaatacagaataattctgctttgttgctagtactgggggtgggggagatactattttatgaggataaataacttgacttagaatatttctaccttttggaacagtgtgctgtattttaagttcaaatgaaacgttttatagactcatcacagctggtggctggaagtgactattgggcaatcactccataccatcctcttcttaaaaattacaagcttaattgtcctacccatgattcctaagtggagaatcataagccacagaattaagaaaaatgtttaacaagtggcccagtgggagaagaatagagtctttaaagaatgactaggagagaatgtctttctatgtggtacctgaaagacaatttcaagcccctacgaataagtagtattattattacttttactatatattaggcacgatgctgtaaggtacctggaagaagaagataaacattttttgggagctttgaggacagtttctatcctgtggaattgagtacttctcattagcaaaattgtaggccaaatttcttcctctcacccttctcttttagatcctcccaggccagttttggagcacctgcccacccctacccctaactgcatttcgtggaatccatttttttgctacaggcgtcatttacctctccccgtgccaacagctcctggccgcccttcccctgtttgtatgtcttactcctgtttctaaatctgtgcaccattaacatcttcatggagtttatcttatttgttgaatgagacactctttgttttagtgaatgtaatttgactgaaagaattccagttaaggtagaaatgtggttgctgataggacccggagaaatttcatagaaatcaggggcaggaaatactataatgcctgggccttgcgggagacagaactggaaaatgagtctggatttaaacaggtctgggagcctcaacagacatggagtccacaggcttcattcgaatgctttgtcatcattatgcttctgtaggcttttatgtgtccttcattttgggccctgcaaccaacctatccactgtcttacaatcccaaatccaaattccttggaagcaaatccattggactgcctcatcttttcccattatttcccaggtcatcaaacagcccatcagatgcacttgggtcgagctgcattgaggggagagtaaggaggaagagtctcacacagacacacacacacacagacacagatacacacacacacacacacacacacacacacacacacacacacacggagcatccaaggctgtggcctctgatggatagtttgagaaatgggagtggtgtatcctctaatataaggtcttaagataagataaaggcccagggacctttatggaatagctaatacgttatctcagcaaagtagtgtttgaaagggagtaaagagctaaggttgattttcacttatattcaaatcgtattgaaacatcatttcctatttttcccagggtcaatttctgacagcagtttgaaagtagaagacttaatacacatattcttatgtgtgtgtgtgtgtgtgtgtgtgtgtgtgtgtgtgtgtgtgtgtcgagagaaagcatatggacactattgcagcggcaacagaagagaaagtagtatggacttttcgtgctagaggagattttagagatctgccggcccaacccacacattttacacatgaagaaatccgcactcataaaatttagatggctaacttaagggtgtacagctattaagtggcagaacagagactcggatctcagatctcaggcagaacaaatctcagatccccaatccattgagcttcacaacccagctctattatatttttgtctccagaaagaaagtctttattattaggttggtgcaaaagtaattgtggtttttatcattaaaactgcaaaaactgcaattacttgtgcactgacctataattgaagcaagcccaaatatatatcatgctttgtcaactgcatgattgcttattaccttttagttctcacctcaaaggttagtaccccaaagggctccttgaccactacctacagtcagttccactccttgttccccaggttttccatgataccattcttttcttacattcaggtcacatgccccaatctttaatcaccttgtgcatttgtgtcctcattttactcttccagtaaaatatgaggctccatgaaggtaaagattgtttctcttcttcacgtctgcatccctagctcctgtaatcatgcccagcatattgtaggagcacctaaatagtcatgcctgtgtacatttaatacatataaatattaaaataataagtggttggagagaacacataaaatcttcttggccacatatacttcctaattactgacagcatacaaagtttaatatctttatgctattacatttctctaaagatccccatatatttttgtgtgctgtgtcataatttcaagctaaaacaacacctggaattcgtagcaaagggaaccagcaacatctgattcagatgtgattttacctgtgcgggtgtattccacataactgtgagtgtgctcataacagagagtaacttggcttagagatgctgcatcccaaatatcctctttgtttgtgactctgactttgtcctgtcactttgtttgtgacttgtgactttgtcctgtgactctgacggtaagaattgttcattcttatttctggctcttggcagcctacagatgcttcctgttagtgctcctggcaggttactgatggggcctgttgtttattgccctatctatcaagtcctatttatttttaaaataaactttaagtatactgtaaactcccttcacaaacaaatttttcctcctcttttacacttgacacgcctctaaaaggaatagtaactctgtctcataaatatttgaacctgaaccttttaggaaagaattatacttaagctactcaagagcaggaaaggtctctgtctgaaacctcccttctaactactcacttctctcttcctcttcaatctctctctcacttttttttttgcattatcttatcccaacttttatactgctctcttatcccactgcagacccaattctctggtcaaaactgctgtccatatctttattaagtattgcttatataatgtaaatgtctttattaaaaatattaaagggcttactatttccaagctcatcaaacccaaatgttttacatctcttgcttggtcctacatcatgtaaatttactattttattcaatcatctaacacaaagctgatgagaaaagacgttgacatggtaaaacaaaacaaaaatgtcttggggtttagattcatactgacttgggttcaattttaacactactacttattaactgacagccttgaggaagtctcctaacttctcttactatgctttctcattggaaaagtgaacactaataatacccatttgagtacagattcatggttgtgataattaatttgaggtgtcaacttgattggattaaggaatacttaggaagctggaaagtattacttctggttgtgtctgtgaggtttccagaggagactggtgcatgaatcagtggactgagtggggaagatccaccctcaatgtgggtgggcactatccaattggctgggggcccagatagaacaaaaaaggagagaaaaagatttcctttctgtctctcctagagctaggacattcttctcctcctggccctggacatcagaaccccaggctctccagcctttggacttcaggactgacacaagcaacctgctgggttcttaggcctttggccttgtactgagacttacaccatcagcttccctggtcctgagacttttggacttggattgagccacgctactggcatcccaggatctccagcttgcagacagcctgtcgtgggacttcacagcctccataattatgtgagccaattcccctaataaatctcctcatatgtctatctatgtctatatctatacctatatctatatcatctatctatatctataaactgtcaatatatctatatcctattggttctgtttctctggagaaccctgactaatgccctggcattctctaaatatttatagctcttgtctttctaagcacatggtagcattactttccaccagtacttttcagtttaggaatggttaaatgatttgttttgactaatgaaatgtgagtggaagggatgtgtttcactagtggacagacatttttagagacagtgtgtgatttacaatggtcccttcccccagtgaggcaaatatgaaaacatatggagaaagctttcattatcctgggatcttggctgtttacaataagcaaatcctcctactgacccccactggatatgcagcatgagctattggggttgcttgttattacagcaaacatttttgtatcctaactgaaacatctatttggcaaggttgtttggaggatgagtgacaatatacttagagaggcaacacagtgccactatgcagtcaatcaatggtatctgtcatcatcaggaacattatcattgttagcattgttattttgttagatttatttctatcctgagttttgtcttgattcccattatcttattgtgctttaatgtttacatttcttgcccttcactaaattataagatctttgagaaggacagcatacttcatgtgccctcagtcaggaataacccattagatatggtatccattccaacaattttactgttgtagcctgaatgcaagtatacataatacataaacaaatgggcatgtttgtattccagtaaaacttaatttataaaaacagaaggcaaaccatagtctgtaaccttcatttagactctattcttatccttcttcctccttctctctctccatcttcaaccctagttttcctctttctcttgtgggtatgattgtattctctgcttccccaggtaacctttttcctcaaagataaaagtagccaccactataaaggaagtaaatcccctcctcccctgtgttcttccttgggtaatgtgcccacacttgagccaatctctgctgacagagcatgggaattcccgagtggtcaggcttgagtcatgtgaccaacctgatgatcagagaatggtctgtgattgaggaatctttcaaagccatcaggggtgcagatggaagaaagtaagatgcttggtagacacaacagggggcttcttacaagctcttttctcctacacatgcagagaaataggaaagaacctagtccacaggaccatccttaacaaatatatattgggtagtaggcttgatacttcatagccaatttccctggatattctttaaaggcttcctgtgggatctgcaaacaaaagcgttagcttgtatttctgatggattggttgtgagaggtaggaaatacagcaaacgaaggagactcttaagtttctggccgaagcacctgggtgagtggaggtaccatatatttagatggttagaattcatctcctaaactgtaaggcggaagcagcaatatggatactccccagttggcttgtaagtattttccaatgatctgggaaaacttaccaaactttacaaaagctaataaacaaagtattataatgttatatgagtcaggactccctggaaactatccaaattcgtctctgtaatatggggaatgcctgaaaattcctaatgtgcaataccatactacagggggaaaaataaacaccttattcttgctattcctggccacataaggtctgtgtaaagggctttactggctgccgtagatatgtgttgggcactcaaaaactgagtcagtttagtataccagtacatcttctatttttactttgctcagaaaatctgatgaaattatacaaatccctgaaatctaatatttttatgtgataagattgtgtaagaggagggggtggaagagaagtttggaaaatgtggtgacagatggcaagtgggctcaggcacatagcgttcctatatataggggaggggacaatctggttaatcaaggggaggggggagcactttcaaatttagattcaagtattttatatattcagcaacatcatttagtgaagcagcctagccgggtagaatttttaatttttttcttggttgggggtgagctgtgtgatatatattttcaacagttttccatattctttcatgatgtctacatttaacaatcaaattgtatctataagttttgggtgtgtctgttgagagagggctgagactatatatttctagagagagttccttccaaggaaatttacaacatttcaaaaattagggtcattacaactaatttaacaagaatggaaaattaaagtgaatgttcacaatgaagatgtctttatagttcagtagaatgagcagtgagctggcaatgaggacacttgagttccaggcccagctctaggtaatacagtcccaggtagactgtgttgccttacacagggcacttcagctctttgaatcttagtctgtttatttttaaactgagagtccagattaaattatctataggataatcttggttttatatttccattgttataggctgtgtgttagtgctcagttagttagaatgcttttgattccaagtaacaacagaaagcccaactgaagctgtcttaattcatcacagggaaagcctagtgttgagtggactttcagattggtttgattcaaaaaaggacatttccccagcttgtttactcttctttccagggtgtcggcctcatcctgacaggttggtggctcttcagaatctgaaaatatcagttaatgactcctgattaatgttatgcttttttatacaactctggatgaaaagagaaaatcactttttgaggctgtcttagacaagtgaggaaatgtcttttagaagatccctgaaaacttgtccttgcatgactttggcccaaactgacttttgttcatatgtgtgatcatgtcaagggaatggggctaccgtgaactataggaaagacttctggaaccagccgttagcttggcagagagattgtggttacataagtgaaaatcaggaaggatcataagtaatggaagcaaccatgaaatctaccaaacatggctttgaacacttaagtttcatatgatctacacagttaaatatgaactagaaaaaaaaacaaattaatgaaatggaggttttatatggtagctattatcgtaccaagcacatagtaagcattcaataaagatgcctaccttgggctaaccttaaatctgttaaacacagagaacatatctcttagttgacaactaaataacaagaaattgcaggtattttgggggttgccatagtgaccagaggccttctgctgtacatttttgttttaatgcagtggttttcaaacttggctgcaaattggaaccacttagggagctttgaaaaacgctattgcttgagtcccatctccagagttcctgatttgattgatctgggtgggggccagggcatttagagttttaaaaactctccagattattgtaacttactgccaagattgaggatttctggcttagggactccaaacatgagcatgcgaggtgtgttctcatcccctcttcccttgaactcccttttataattctctttttctctactctaaacttgcaactgttagattcttctccctgagctgggactcccagagataccacatgttctccattacactatgacaaaaacctgaatgtgagggtggaaaccaagagtagggaaggcgtactgtcaatagggtgtgttagaagaaggggacaaaggggtggagaaaagaagaagtgatgcaaaaagcattttcctctggcactaggatgaggttggagatgcacatttaggcactctcagactcagattcccacacaaacacccatacacatacagacacatcatctgaaattcttcccagcctcctccctgctcagcccactgccaacggcttgcttagaatcttgctgcaaattcataaaacacctaaaacatgaataaatgagaagtgactgtgtattcattcattcgcacattcatgtattcatatgttctataaatattgattaggcacctactatgtgccaggtacattgccagatggtgagtgaatagtgataaataaaacaggagcttatagcacattaaaggccttaaatctggaaagggtttggagtgtatgaagcagggaaatgattatcttcttcaacagtaattgagttctagtctccgtacctcatttgttgagtgagtccttggtaaacaaatgactgcccaaatgaattagtgagaaaagaccagagtgactggagcatggtgcatgtgcaggtgtttagggaaaagtggaataatattaggttggaaataggtgtggatatcagtacatgctggatctagtttttaaaaaatcagacattatattctgtgcattgggaaataattacatattttcaagaaaggagtgatatggtcagagaaagtatctctgaaatcaggggggataaagaaagggctatctgggaaaatagtaaaatggaaaaatgtttctgaaagagagaacagaatgtgcaaaagctttgagtccagaatggtataatatggctgcgtgtggtgagtcatgcctgcaatcccagcactttgggaagccaaggtgggcagaccacttgaggccaggagttcgagaccagcctagccaacatgatgaaaccccatctctactaaaaatacaaaaattagccaggtgtggtggtctgtgcctataatcccagctattcaggaggctgagggacgagaattccctgaacttgggaggcagaggttgcagtgagccgaggtcactgtacttcagcttgggcaacagagcaaaactccacctcaaaaaaacaaaaataagaaaaaaaaaaatggtataatatgtttgaggagctgaaaggcactatgctactttgcctaattatatggacataaaagatagtctagtggagagacaataatagagaaatatgacacagaacaatagatgctacagcaagtgcagttgacagaatctatgggagtgtagaggagggatctctaacttagacttgggaggccaagagaaactccatagagaatgacatcaagaacctaatctggaaaagcaagctgagttaggaaaaaggaaggggaagggaaatggtaggtagaaatgaaagacagagcaaggatttttcaaatagaaagaatgtttcaatagaattctatacatttgcacattcaaaggtatagagaagtgagaaaacatcttacaattctgagcaaaatcttaattacaccaaataaatcaaatttaattttaaaactttatagaaatttatggtataccagatacactgatatgcatctagcaatgatcttttgaagcaggtatcagtgaggcaacttaggtgaagttacatagaatccaacagctagtaagaggtagagctgaaatagactcaagcagtttgactccagagttcattatctcattcctgctgttagattgcctctctgactacattaaaaaataaataaaaggaggaagacccaaagagatatagattaaaatatatatattgctattttcctgtgtttttctactatttctggaaattgtctagttcacataattaaaaactcaagccagacaaaagagaataatcagctatattaacagtaagccaaagacttctattcttcagaaatttacttaaaggcaaatcagatataaacctaggaagtccagaaaagttaataggacttaagcccacaccaagaaaataagatatatgtatgattaccttttttttgtagttaaccactgacactatgtaggatcctatagaaaaagaaaggcattcctgtttttaattttttgtttcatgtagtaaaaaatttactaccacaaaagtaaaatcaaccacaattaacaagcagtgaatggaagttgaatatttcaagaaacaaaagcacaatactttagattggttaagtggattaagagcaccattagaggactgacatgagaaatgtgatattttgaggaaaaaataataaaatatgaaaaatacaatgaaaaatcataaaacataaaaaacatatattaaacaaaaaaaattaaacaaaaaaaaccatatattaaattacaattttttaaaaaaaacaacagcaccaaataggcatgtttggaaaagtgttagaagtatgtacacttaaatgtgaatactggtaacatttgtgtgataggttatagatgacttttaaaatttttagtttagatcttatctaccttttaacatatgaatacgttattttatacgtaggaagaaattataaaacatatcaaagtcctttagtcctaaaagtacatatgaaagctttgctagccttagtcaacattataattatgccctcaatattcattctccttttcccattattatcctaattctcctttaagtgccaccctcccccactgcatgcatctcttttgggggatgctctcctgagttagggatgtggcatgtactgtagttctaagcccaacaatgtgatccttccccctggtcaaggtcactggcttaaggaggggcaagtgacccaagttaaactaatgaggcatgacaagtaatttgctggaggaagctaggaataaataatccttgctcatgtgagaaaaacccaaaacaatcgtttctcttgttcctatgtggatgaggaagcacatagcccaggcagccattggcagccatgtttcagccgtgaggagacacctgccttagaatgaatagaaatcctggaaggcagagagagttggaaataagctagttctttcatgggttagtggaattgctgatcaaacccaactgcaagtgagtgccacctgtgggctatcaacccataggaaaccatacatcttctttattatttactccagtttgaattttgtgtgtgcatgtttgtttttctgttaattgtaaccaaacacatcctacttctttctttctatgctattttcatcctggaaggttactatcaggtaattaaagatctttcttctagcttactaaaaattattcaaaatcacaggttttattttccttgacctggctggtgtattctagaactgtgctgtccaatacagtagctatcaaccaaatgtggctatttaaatttaaaatagtttcttggttgcacttctgacgtttcaaatgcttaatagctacatgtcaatagtggctaccatattagccagcagaaatagagaacatcttccacactgccgaaagttctcttgaatagtgctctctctctctctcattctctctatcccccccccctctctctctctctctctgtgtgtgtgtgtgtatgtgtgtgtctacgttggagggaggggaagcatacaaaagagtaacattagattgggaaagttgtattctaacatcatctatgctagttaatttaccacgttcccttgagtaagcctcttcccctttcttaggtcttcatctttcttctaaaagtaagaggctagactaggagattttgggggtctcttctaggtccaatatactgaaattttaagtgctttcttttgacttttaacatctgtagactttttttattctccagggatcagctgtgagctctaccatcagatcatattggatatcaaatactgagaaccagggtagaaaattcaggacagtttcctttttttttcttctagcaaaaaaattccaacacaaatttagtggcaagtaggcattgtttaaacggtgtacaggccagtttcctttacttagtgtcattgcaataggctaacacaggacaaggtggtcacccttatttctttcctttcttttttttttttttgagatcgagtttctcatcactcaggctggagtgcaatggtgatctcggctcactgcaacctctgcctctggggttcaagcaattctcctgtttcagcctcctgagtagttggaattacaggcacctgccaccatacccagataattttcatatttttagtagagacagggtttcaccatgttttccaggcttgtcttgaactcctgacctcaggccatctgcccgcctcggcctcccaaagtgctgggattctaggcgtgagccaccgtgcctggtcaaagctacttatttctgtaaaggcagctcattatgcatgccatcctgatggtgaattagtattttatttttgattcatttattattattcatttagtcattcaagcattttattgtctactatatgccaggcagtatgttagactctgaagatgcagcagtgaccaatatgcttgtcctccttgccctcatggtgattgttataaggagataaagcaggcattaaacaaataattccagaaatagctattaacacttgtatttaagattctagaggtgctgtaacaagggatataaggggacatagcacaatgacctgatcttgtctggagtactagagaaggctttgggaagaaagtttctccatcctattcaaggatccaagagaagagcctagtagaagccaagaattagaacatttgtaagagatgaggctagagaagtaggtgggtcagttcatgcagagccttgtcaaccatggacataagatttggactttattttaaatgcagtgggaaactattgaaaggcttttaagtaacaggagtgacataatgatcatgtgtcttaaatatgctccctcaagatgcagagtcggggagacacaggtgggaggtacatactccaagacaagtatacttgctatagttcaggtaaaagatgatggtagcctggatgagggtagttgaatggagagggagaaagtggatggatttgaggcataaacaggaagtagaattaataggtggtagtgactgattggatgcagaagtttatggggagggacatggccagaagagtcttcatttctggctcaaactattgcgttgttgaatggccattggaattgagtagctttgggggatctgatattaaatcagctatggatttgaaagttttgtaaaccaaaaaaacatattattgtttttattattgccaaagcaaacattttcatgacctttatatgcttctgatatatgttcatatccttgcaaaaaaaagagactactttgttgctataaaaatatacatgtattgctttggttagagaaaaggaggtgaagctggtgggatttcaactttctctcagtcctaaaaggagaataaagaataaagaaatgagaagcgtaagaacaaaagaaatgaccttattctttctttttcttctgcctggaagacagacaagataagcaatgaggaattatagttgataaagtaattgtagagataggctgctggaggtgaaaaatgagactcctacatgaaggttatctttttttccagcctaagaaaaatcttgtctcccattttctttttcttacagttactgaaaattctgccttacggatccagattcaaattatagtatagaatattgccagtttgatagaaaatgatttagcctctctttccaactgtgtgcattccttgttgctactaaggatttttattctttcttaagcagtagttgggttttattttgttgttgttgtttttttttttttggttgctgcttttgtttgtttggtgtttaccttgtgaatgctttgtacttttaagacatagttgtgattactgatgtgtataatgctctcctcatggcctagtgcagtgcatggaacataaaaattcaattaataagtgaattacaagataaagttttcatcagtcagtatagactagatgatgctgcaataacaaataactcctaagttgcaattgcttaaaaaaaactatttcttattcactaggtagatccattaaagattggtaggggaagaggaggcctctgctcaaggactcaggctgatagtgcaacttgtccctgcttcaaaggcaagaagagatctgagggtgtcacttcagcaattaaatgctctattgcttgaggaaatgacatcagttctaatgacacctcactggctgaaccttatggcatacccaaccctaaagggatcaggaagtgcaatcctactatggtcagaaggtggaaaggctcaacttctctgaaaaatgtgagagtagttttgctttgagttgggagaatacactaaatggcctcaaagatcaatatatgttgattcttacattattaggacaaatgatcattggctgcaatgcaatggactgcaaggtatttggaagaaaaaaatagaactatgctaatattcttgcttcattacatgcatttagaatgatagttaaggcgagtctttattccagtatttttttcttaattgtcagcaatgcctatctgaatgccttgaatgtaatccattaggtggtcgattaaattgaattatggaagtaactatcttgacccttattttaatctctagaaatgaaaaacataatggttacaggttttcaaaatagtagcctttattagcaaaggtgaacttccttttaattttaattcattagcatagcaaaaccacaaccaacaacaatcacggggcaaaagccatcttgtatacttctatatttcaaatgcctggtgtaatatgtacctctagaaagaatgaataatcattttttgagactatcttaatgttaaagaaataagaaaatataatagttatttttttggattttttttccattaaatattttatcccagtgtttaagaatgtactcttgagccaaatcatttgggcttgaaatctgctctgtcttttactaccacacaaccttgtgcacgttctttaatcttcctgtctcctctcacattccccatctgtgaaacagagataataataatacttatcttgtggggttggtaaaaagaattaaattagactttacaagacatactatagaatgtgctagcatctggtgaaggtttgataaacattacctgctgccactgctgttattatttttttatcttgatgctgtacagtcagtgtaaactttctgtacatactcatgaacaataataatgaggcacagatgtgaaacatgcaacaccaactagaactttgacatttttaactgtgagattaatatttactattacttagaaatctgtttagaggtaagatttagagaacagttgttatgttacaaagagctattatgtgtgttttgtgcaatgtgaaagaccaattggcaagactgacgagtctgaaggatccctaactctctcactgtgtgtaacatgagaaaacagaatcacttgcaaagatgtgcagcagcattggaccttctttattgtgcctctgaaaggcaagagagtattctggggaatttcaaaatgtttccaaggaagcaatattatgagaactaccttgattttgaaaacaccataaaagattagacagtatcatctataacagtggggatctcatcaatcacgttttctgctttgttcccaggcacctaacacatagtaggtgctttataagtgatttgtgaaataactgagggtatttcagagaattattaccagcacaatctataaatgaaaactaggtcatcttgtattcatcattgaaatttaggcaaaattatactatatttctgaagaagaaagggttcaaaccgtagtaagaggaagatgttgaacttctgagtgttttccctccccaccccagcatgttatttgaaggagaggaaaaattttttaaaaaagagctgtgagcatatttcttcatttgatgctgaaaataacatatttttatttattaaacatgttcaaaaagttcagaaggtttttattggacttatgcatatacgcatctatgtcctattccaggtaaattctagtctatttaactgctgaaacaaccagcagacttaaattagtataaacctgacaatatttgtggttaatttactggtaaaaagaacattaagaggtaagaaatggcttatatttcactttcccatttactgttagaagtctaactcccactaatactatcagtattttgcagaatgcttttttcttgtttctccttccctctttactcttttgttaaatcagtggtatcagtaggacttctaatgtaataaatcaggcaatataatgttaaagcgctgcttgagttgttgaagagttagtaggcagatattacaattcactgtagctgtaatagagggtaatgtcactttaagacatgtgatactttagagcggagggatgtattgaaacagactactgctacttacagcaccgtatagcagccctgctcctacattttgctgccttactctgccccgaatgcactggagtggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaacccgatgtctttttttttactgtggaaataggatcggaagagagtaacatttttttttttttaatcctgataaagaagattgttgggaagctctttgaaaaaaaattttaaattgtggcacagatggattttaaaaagtgttagatctttccaatgaacactaatagagtactctgctcttggctggatttttcaggtaagaagcatctttaagggtttaagattcagaaagcagatctgaaacatatccaggcatatctagagaactgtgcaaggctgaatgctttatttggggaagacgcttaataacattgagacaaccccttggtaaaggagcaagcagtgagagtgacatgcaggaggcttggaagtaatgctgagaatttaaaaaagttaaattaaaaaaatatatattgcaagcataaaatcacagtaatccttttgagtggtaggatctatatgggtgaagaaatgagcaagagaaagcagtcattgaaaaactattaagttttggttgtggcaggatttttttttcaagtttggatgaatttccagtacattttaactgcaattcacaagcagtaaatacatccacagtcacctctgttttgtctttctgtaatttgcagggtattctgaaaaagtccccaaatacattcattttaggtttcacaggaggggtgttgctgtttatttccactgaagagaatgcatgtatgttatcccaatagttctgaaaacaataaggcaaagtatgttgtatacaaaagtaaacagtgggcagtgaaactaattagaaagtgaatgctccatctgaatcacagacttaggcatgaatagcaccaagctgttgaaaataatgttttcctgctttgcacttaattatagttgtcaccatttgtctattatagtcctaaaatccttccaagactgcatctctctgctaaaatccacaaattagcgtgcattatgtgcatacatatgatgtatatttttgttttctgaacatcagtttttaataaagaaccaattttcatgaataaagaagccaggctgggaggttactagcacgttttcaacgtatagttgagatttttgaagggtatgatttgacagtgaaaaggaaaagaaagaaagaaatcttccaaagccctctctgcctaacagaaaagcatacagttaactggattcttgtgtagaaaatgcttccctatcactggctgagtaaggacggtgcttcaagtttgattaatttggcaatatgaaatgcagcataaggtgttgtttgagaaattggacaatatatagcgcagttgagcctttgtagttcctaagatcctcataggtgcagataagactgtcaaagtttcagcacccgagaaaaggtacatattcatccataaatacatatgccacctgtatatgcatattcatcaatgctatacaacaaaagctacaatggaatcttaggaggctaagcaatattgcaaattatggcttgctctaggatagaagcataggtgttgcatctgaaactcattctggctaaacacaatcccttctgattcttaggtccagtcaaaaggatcagttctatcaggagattacaacatgcctctgagaaatgattacttagtttagaagacagcattgcaattaaaaattcatgactgtagaattaaaaaaaaaaaaagaacccactctttccttccaggcttatgtcagacttgcaatgaagttagaatgaacaggaggagtctgcagcttttcagtgcctgggataactatagtttaaagatcattgtgtaaaataggatttttagtcagcatgcattgttttaaaccgactaactgatagcctaaaactttatttttgcattttgccaatccttggagttttgttttgcagaattaagaaaaaaatgaatgtatgatcatctgaaaagggctttctctcaatcccacttcatggcatgacctctgctggatcattagttctagccagagaagtagcaaaggaacatgacgtctgagacctcccttccctcatcagtggggctgactgagctgggggcttgaagccggaggtaacctttcctgtcgaatgttctctttagagaatggcaatggtctctgcgatgtcctgggtcctgtatttgtggataagtgcttgtgcaatgctactctgccatggatcccttcagcacactttccagcagcatcacctgcacagaccaggtaagtcaggagctggctccactgcagcctcctccagtcttaccactatttccttaacagatggttgaatgcaagtgacataaagtgctatagtgtgggcagcttgcctttgaattccaagacatattgttggctggatgctttgggggaaggggagtgtgccaaaatgtcttggaggtatttctattaatttctcagaaaaggtgtgtttttctaagtgtcaccccacctgcttctacacaccttgaaaagtagaagtcatctgtttttggatgctttggccaatagcagaatattctgcaaaagttggaataactttcaatacttgaggattttacctactataatcttggtctgtatgtggctaagaattttgtgggggcatagtccccaaactaactttggaagcaagttgtcaatgaaaaagaaattaaaaagtaacttactatttcttgcctggtttaatgtgccttctttcctttctcccttccttcactttctgttcttctggtatgctcagtggcatttttccctctcttttggcagtttcagggacgaagtccctcccacctgatttttgttttgttttgttttgtttttcctatattgaatttttagttccggacgcattttgctttcttcctcttaatgttcaaagtatatttctcacccttccacggcctcgctcttcattctggattttgctctccttctttgcctctccagctttctcattacagtccctcccagctcgattgtccttaccttccccggttcttggaaaaatttccttccattttctgttcagtatcagccttcgcatccttctactactcaccccgccttcaccctccaccccacctccctccctcccctcccttcctctctcgcgacggtcaagttcgggctctggggaccagttgcgcgcccaagtttctgatgctcagttctgaagtgctcccagccctccacccgcctctccaaatcccatcaatggcctcctccccccatccgtcgagcttcctcctgctgcgtagtccagcgtctacgccctcgcctttccctggctcctcagtcggcctggacaccgatactaggctcttctgtacagccctccagcaataccttccggggccccgcttgctgcctcctggggctcagcttccctgctgggggcaggcatgtcagagcgcggatgcagcccagggtcctcccgcgcgcctgcaccaggctgcagcgagcgcgcaagcctgctgggtgctggagctcgggccgccccgggagaaggggtggggctggcttgtgctaggggctgaggctgggggctgtttctgggccctgccaccctgtttcccccagccctggtctgacagggaaggcgagggggcgctggtgcccctgcaggtgggcagggaaaccgccctcttcaggacgcgcttgtatttctgcatcctgtgtcctgagcctggcgcgggaaccgccactcaaaccctcagtgcagccgagatggagggaaaacaaaagtgaatttgagattcccactttacctccaatcacttaatcacaatttgttctggcacaaatgtctttcacttgttacatggtcataaataataaacagtgcgggacatctgcattcgttgtgatgatcaagaataagaattcataataaaaacaactactacgtgtatgttttaggcagggctctgaggattagttcacactgttcagtttaatccttatgcaagtgggtgtaatttctcccctttcgcccaggaaacagaagctctgaaaggttaggtggcttgtctgaggccacacagggaatagctgccattggaggtcaaatcagcacgattcaccgccagagcctgtgtcctcaggaggcgaaaatgcctctcggtgcaccgagtgaccatgccaaatagcttctttgaggaagtgtgagccccttcatataatttttgaaaactttcattatgtcaatacttggtccaatctcaactgcacacccattctgagaggtggccatggcagaactagtgagtggcacgtggttgagggggaaaggcagggctcggggctggccacctgagtctctgtcacttaaggttagtgacataaccttgggcaactgacttttctgctctcattccccatttatagatatggtggttgggggcggggagaggtggggtgtaaatataataaaaataacttcgaataagtcttttgtaagctgtaaagttcttcacaaatattgggaattactgatgtccccccttaatagactgtaaacccacaagccagggatgtttgatgaataaagttttgctgttcacacagctaataatccacatagccaaggcaacaactcttttttttctcttgctattgttttgttaaccatgtggtacatggctagaatatactaccaatgctatgtgtcttattttactctgtgcgtataatcatgaaatagatacagtaccgtttgtaacaagctttcacatagttgtctctcttaatcagtgaatatatggagtttttcattgggggttatgtataataagtaaacttatgtctttatagggcttattgttaaaataccgtagtttaaaactgagaatcacatattaggttctggctgaaattaaactcaatatttgttttctccattttcttccttagaatttgtgtattatcaaccaatgcgtggttgatctgtgcgtcaaataccccaagaaactgcagcactgaaaccaattttgaccccaagtgctaatacatctgagacccatttcagctttattgttgaaatgaagaaactataaatatcccttcctagatgcagaatgattaaaatgatattaaacttaacatccaatagttctatataatacgtttattcaactttctttggtttttgacaatagctgcaaagattaaagtgatagatcttggtcatagccatattctagattattccagtcagactctttaatacaatcttttgattttaagaataaaaatatgcttttattttggatgagagttgtgacgttttcccttgtaggtcttaaatctccagggacactaatgaaatgtgtatgaaaacaagatagaaatcagggccagttatctgtgacaatccacccctaaatgaacaaataaataaataaattgctggataaatgagcaaaaaggaaaaacataatctcattttctcaaatcggttaaaacaagtgacatgatgagaaaaaaatgagacacccgcagaccctgagctctgccacatttgcctaagcttgaaaaatcacctctttcataaagcaagagcaggcagactccgcgtgcataccaagtatctgggaaatgtggaaaatgacaaatctttcactcagagccttgaatggaaggagagtgaaagctttacagctgcttcctcacctgcttaggaatggctccccccaatcccctccctctgttccccagcctcttacgggcactttggctgttccttgcatggtaatattgatggtattcagacagcaaacagccaatttcagtctctcaagaaataatccactacattgacaggtgagtggaatttgacgtgatgttcccctcgttcagattgcctcacctggatggcaccagccagccagggtcctttaggggaaatggttagagacttgggccaatttctgctgtcataacatgaaatcgagaccatgtttttgtgaggccgtgaatttgtgatctgtcttctcaatgcagtgggtttgtacacaaacagaatgagaatatgttaactagaaaactgactcattttaatgtattcgcctgcagtccctaactacttcctatttttcatatttatagtattaggaatgcaccatttattttcagttactcactagttaaggaagattaaaacagtcaatcaaatgaaagtgaattttaaaattacactaatgagtaaaatgtgctgtagattaacagatttgtaatttcaataatttaatatttggctggatcaagtttttatttggggaatgatgtaggaaattaccctaaaaacttgaagaatacttgagcttcttttttatttttcattataaagctatagacaggacatttagttgtaaaaagacacactaaaaaatgaaaactcaaaagtggtgttcaattgtttcaggtaattataaaatagacacctcaactctttataatcaccaggtttttttgtgtaacaggtaaaaaaagattgaacggtttttgctaatcataattttctgttttaggatgagtttttccccttatggatatatgaattaggacagcaattttgatagttacttaattttgaatgtgtgtgtgtggggggtggtgggggggtgggtgtccttgaaacttagtaaaatataaatcatctcaaaattatttagcaagagaagatccttgggattcttcagtaattttaaattatatagataaattacatgagacaagaagttttaagtgcctaatgaatcatttattcctgagtcactgctattttatcgacaggggtgtacggaaatgatatataaaaagattactctgaatagagttgtctgtgtaatttatacttgacctgatttaaagctatattaagcaaactatgtgtgttagatatattcatttttgccttgattattacatactgaacatcaccttccattttaaagtaggatatttttgttaaaatattaaaaagcatttttgtatgccttatacttatttttaccttactattcaatattactttattgaaagctgctcagagaatatgcagtagaataccagagtacattacaataaagggttgttttataactgtaatataaaagaaatagtgggtacaactatggtcgcatattggctctttaagaatgcgtaccagtgctaggctgctaaatatagcgaattggcctaaggattggagcagacaggttgttattcggtgcaagctggtgcttagtgataatccatcgatcatctgattgatcctattgacctcatcgcagagtcagggtgcagctattgatatttgatcagaccctataatatcaaagccaaatacagatgcaaataaatatttcctgctgatcttatgaacttataagaaaattattacaatgctataaaaactcttacttacgtaagctcaaacctatggtttcaactcctagttagggaaaatagatgttataccacactgcaaacaaaaatatttagaaatggcaaaaatgaagtttagcctttaattgttaatttcttaaagtttacttaagaagacaatttgaactcttttaaacattctttcaattttaaactttctgcgaaagtatcaaagcttaactggataaatcggcatgccatttttgataacaatttagtaacatctcccaagatgtaaaatgtgcaaatcctgacacttccatttccaggtgcttatactaagaaaattattagacaaatgtgaaaagatgtatgttaagctatagttattgcaacaatggttttaatggcaaaaaattgaagaggagtttcatctccgtcaaaaggggattggtaaaataaatcatagcacatccacacaatgggatttgatgtagacattaaaagggatgagaatatgtctatctacccacgaggaaaaatgcccatgttacattgctgagtggagaaaacaaggaacagaatactctgcttcaaaataattttggagaaaagaatcatatttgcacatacataaaaatgtcaaaaaggatataaacatcctttctacagtggtagttaaatctggtgagaggactagaatgacttgaacttttaacttcctataatttttattttttggattcatttttggaatgaacatatattgctttttatcaaaaagcttaaaatattagtgagagagtttcaatggtaaaattagaaagataccaaaccacgtttccagtttaagaaaaaagaagggagaataagtaggaaaatatcatgaggcccttttccttttaagggtcttaatccagtaaaatgtctaggccagcatttcagaattatacttcatgaaacactgtcttctgaagatactccttggacaaaagtgtccactgtttgttatgttctcctcctggagatttgcagtgcttgtaagtatatgaaagttctggaaagatttgcgtgtaagaaatctgattttgtttaactaaaattttccagacactttttttttcgacagcatctaccatacctattcagattacatgcattgagaagcatgggccaagataattctggaatcctctgttcatccttttatctctcacttctactgagttgacacatactaggttctcagaaaatacttgtttaattactaaggaaacgaggaatgaagattttggtggaatcttaaactgttccttagttgttactacttgtgtgtgagtgtgtgtgtacatatggatgtatgtgcatttttgtgtgtgtgtttataatttcgagatttctcaaatggagagtgtcataaacattattttgtcagtataacatacatgtattatgtgtgtatctttatgtagatatttgactctattcaattttgacagctactccattcaaaataattcaaagactatacttacaagtgtagtaaaaaattaaatccctaaggttttcagtcacaggtttggggatttttctcctctataagtttagaaaagactataggagttgtcttgagggactgaagaggcttcacttggcaaatagggaaaggacttttactttccaaatcttttgatatcaagagaaaaagtcactttgcctttgtagcagagagaaaataacaccagacaagcactttttcctttctttgggaataaagagaagatgaattttgtttaaaatttgtataacctaattgaattccccaaagataataccctcaaagcacttagggaactctgttggcccattatttctttctcttttcccaacttcatataataaagttccaaaaaagaaaagaaaaatgatattatcacagggtttctccaagaaaatggataggaatgctgagggatctgcctattcattaagcagatctttctttaacgcagggaaggagtcaaaccaagttgttctctgagtctgcaagggaggaagacctctcacatccttaggtgtggcattgttctactgatgtaattactggcatttacctttactatgcagttactagaccttcttttctaggtgtgctttcatatcacacaagaataaatccaagctgaatctgtgtacattcagaggacttttcttattttccacttttgtggatgaagaatggaccaattgattcacatactttcaagtgaatacagaatgtcagctcctagatttagataagctaatacacaggcagggggtaaagcacctcagtgttcctgaaattaacagtatactgcattaggatcagcaggccagcaggtcttacttctcattgaattaatattgggtatgtattcaataattatttattgatcatcctagctttagccgagtgagaactttacattctttaaaattcaaaaagtggtagaaaaacatcacattaagcctttttaaaaaatatcaaatggtaatgaggaaagagcaccagagtaggagtcagaggctggagctttcaagatctcctttaagttgtcaaattgcaaagctccagatgagagcgtgggaaggaattcaacaattttcatgttgtacctggtagctccaagagggggatccatgtgttccataaacagtgaagtatattctgccaaataagttttaaactacccaaggaactggtttattaactttatctatttgacatagcaggattcaaaattaccttttcttatgtaaaaaagcattctgctaaaactatttgaaaactttgtggatgatttcataggtaggcaaagcaaacaccatcatggaccaggcaggtgacaaaatgattgttcagatattaggaaatgctgaatattgcaaggcaagccagaaatctaaaaattgatgtgtaattttcttaccttggaaatgtcaggtgggccaaataaatcaagactgatggctctatcctacctgcaggctgtcagtgcataacctcagacaagactacctccaactctaacattttatgatttctaatgattttatcaaatatctttatgcaagcagagtagagagagaagcgagggaagtggaatcaaaaggggatgttctgtgcacatgtgttttgacctactttaaaaatatgcccatggtgtagtcctgtactgagttatacccagcagactaaaacattgtgtctgtaagctaaatggtattactggggctctggtaaacagctttgatataatgaagacaatagttgattcaatagcctcatttgaatctcagctaaaaatcaattaattttctttctttcttttttctttccttttttttttttgagacgtagttttgctcttgttgcctaggctggagtgcaatggcatgctctcggctcactgcaacctctgcctcccaggttcaagcgattctcctgccttagcctcctgagtagctgggactacaggcacatgccaccatgcccagctaatttttatatttttagaagagacgagggtttcaccatgttggccaggctggtctcaaacctctgacctcaggtgatccgcccacttaggcctcccaacgtgctgggattataggcgtgagccaccgtgcccagcctaattttcttcttgattatggttgggaaaaaacagtaatcagcaaatctaataaaacagaagcatcaagcagcatagagatgcatatgtaaaactcttaatttaatactttatgaaagttctccaaatctagtctgcagcccactagtgagttataaatttatcttgaaacccaagattctcttttgggaaaatgatttatgatatcatatatattcattttgtctatgaataaaggctacttattagtaaaacaactgagttatcattttgctataaattacatgttaactagtgtttactgaacttccttaattcagtattctttaactggctgtcagctcttggaaacattgcaaagtttctgtatgcaaagaattagaattcatgcaatgtggagaaggataatttgttatcagtgtgtcatgagtgttgtcttgagttattagtgattttcaattgctgtggtccttgttttttaattataaattagtagtggtttagtttcatcattatcaattaagtttgctgtggacgattgggttaaccctgtagtctgtaatgatggatatttacatattttggattttaaatttgctgaagactagactttaagacattgcttaattgtggttcagaaaatattttatctatattcctattgctaaaacatgtatagtcatgtgctgcataacgatgaatggcttataccacagtggtcccataagattataataccatatttttaccgtaccttttctaggtttagttaggctttttaaacttttgctttaggttcagaggtacatatgcaggtttgtcatataggtaaacttgtgtcatgggggtttgttgtatagattatttcatcacttaggtactagagttaggtttaaatacacaaatacttatcgttgtgctacaatttcctacaacattctgtaccctgatgtgctatacagcttgtagcttaggagcaataatctatatcatatagcctaggtgggtagtagtctatctcatctaggtctgtgtaagtacactctgatgttcacacaatgacaaaatcacctaatgatgtatttctcagaacatatccctgttgttaagcgatacatgactgtatttgtaattatcttaaaatttgcttgtatggtgatgtatcgtgacattgttggtgacattcactgcctgcaaacctctgcaacatattctcatgacccataatatttatcttattttttggttcatagggcatcattttataatataagagcatgttaataggtctttcttattgtatgaaaaataatttgtgattcatacaaattttcttctaagtatttattacttaagcacttttccactggaaagtgaagacaggaattagatatttcaactactgagtgtgctgtggtcaaggaaagtttgaacaccactgttctatagagaaatggtaactagaggtcagccctttataaaaattgcgactttaaaaatatgtggcatagcaaaaagtataaataaatcaataaatcccctattgtgaaataaaatgataagatataagacatgagtacatgttacttggaagcttcccggatgggggtcttattaaaatgaattggttttgtagctttttacatctctttatctgatgaacatgcaagatgccacctactggacaggtgcttgagaatctaggtcactgggtgaacatttgtagggcaacacttttgacagttgcttgcaggattgtttagaagtaagagcaaatttatggcgtgcatgttgccaatctccagacttctatctatcaccagcttaggttaatcagtcacagcagttgctcacacagagcctagatgtgattttagaatctttttcaatctttctccaggcactccctgtcaaatgattgacactggcatgcaagttgagagtcattgaccatcccttatgtgggttaatttgctaaccatcttcagagtatctcttctatccaaaaaatgtgtgccatgaagtttttttcattaaaaaagaagaaaatgacctaagtttaattaaatcaaattgaaatttaaagagccacatgggtccaatagctactgtttaagatagtgcagctttagacagttctgtcaacttctgagagttgaaaaacttactttgtattacctccagaaagttttgagtcctcgcctgattcttctctaactctgtgtctaagatgcaaagctgcttgtgttatgggtcataactgaatagggtactatgtaatcataaagcaggaagcaattcattctgagcagagaagatttgggaagccctcatgaaggaggtgattttgtgttggactttgaaggttgggtaggaagtcagctagaagaacggaagggtggtttatttaacacaaaggaacagaacaagtaaagacttagagacaggtaagtgtaaaaggatggggtagcagaccttgatggctagaggccctgcactagttagagaaacttttgtatcattccaattaaagggaaaacaagattttatttcttaattacttagttttacaatctcaaggctgccttatcagtgtacattgatgatcacagatggagatggatggaaagagccccagtgtcacaatgagagtctctatggaacacaagtcagccaattgtcaaagaagtggcaaccatattctggccagactctctgagccctgtggggcctttcacacctttgaattattgttatctttgtgcaatgaaaggcaagatgtgtcataactgttgatttcaaacatctggttattgtattaaaggaagctgcataactctaactcaaacctaagatagtaattatttttaacttacaacaaacttaatatttatatccaacaaatggtttattgcacctcctaggggcggaggactacagttacctagtagtaatagaaatgacactttactatagtccctggtataactctgatttccctaccacatcacaagctatgtgagggtaaggaacccagcagtctgacaaatgcctgaaacggtgtggcacacagtgagggccaaataaatacttgctaaatgaaggaacgatcttaagcatttgatatttcagttaaacctcacaatatcctcatgaggtagagcatcttcccatttttctagtaacaaaaatgtaaaagaatatgttaatggatttgtttaaggtcacctagcttgggagggcaagttgggagttttgccagcttctgaataatggctcggtttactgagtgcttgctgtatacaagccttaacatgggatgtttcttatgatatgacatttggtctgaaccaaaaccctacgtagatggtactgttattcccatttgtacaaaacattgcaaaatgtgcttaataagtataaacataaaaggaaaacttaggttgtgtaacaattctcagtcaggtttccgttacaaacaagtactacttttaggaatatcagcaatctactcttggtcaattgaaattaaataacaaatttctatgttgaggagcattgttctacattagccaggcatctgtttcttgggcagttagcttgttgtatatcatgtaatagttttgagtactgcagctgaataatgcttgattcttaatttccctatgcaaacaggcctggctgaaagcatggtttttttcctttctggattaacagtgcctaattttcaagcattttttacagagttattgtttcccaataaattcttttagactccatagacccttttgtgccccagtcagggaagcagcagcataggataaatctacatttattagacttgctcttagtgtagattttttggtttacttaaaatgaagttataaatcattcacactggaaaagaatgctctccaactgcaatttaactttttcataagattgtttggcatttatcatgttgagactttataaattatctagaatattgtataatgggttgacctttctggtaagtgatttgatcatttgcagcagtgtctttttgctaaaatatagaatatgctgtctttcaaataaaacttgctagacccatagcctaataacatgttaggtagaaattgcctatataatcagacctgaaatttccctttccaattcttgtcatcatcaaaaacaaacaacaacaacaacaacaacgaaaacaacacccctgtcttccaaagatagcccgccggccagtgatggcaaattcctgacacacagcccattcttcctatgattttgctctagcagacattgctgatcaattactatatgctttgtgtttgaacccagattcaacctctgaatccttccaagcacagtatagttctccagtcattgagtaattaaatgagacaggaataaattcagaaacaaccagaataactcctcttagaagaatcatcatccagcactactatatgtcacatactgggctaagtgccctacatggacttacttgttttgttttgagatgaaacatgttgtctgttcctgggataggctgttcttttatgcaattcagttgtcccatcaaaatgggccacgtagcatctacttacatctttggaaattgggcaaagagttgatttgcttgcaggtcttttacctgccttcaccctctttgctaccagtgactctgggtctgaggagtctgcagggacaggggaaacttggtatactaggccaaccgggagtttacatcccatctctatcattattacacttatttgctccaggcgtgggcaagtcagtgtaactttctctgcctcacccatagagtgggggtttgtaaaacccctaccttgccagcttaagtaagacatagcgataatgtgtattctgtaagaaatagagacaatgtttggtctacacttgccatatagtaggtgtttaggacatgttatcttcttatattttatgtaaatatgtgaatgtcagagcaaggatggaacggataaactgcctactactaacctgtatgctgataatattttattatatgaaaagatgcacatagaagttttacaacttggacttatttactcacctattatcatacctgagtcttctgataataaaatccatgtactcatcacagtacatgatatagatttttatggttaatctctactatggaatacataatagttggccacatgttctaagtcaatataaacaggtcaatgcttattgtatccttccttccaaaagtacattgtgtacgtaattacaggtgaaggtggtctagttaagaagtttagtggtgtctgaccgggagcagtggctcacacctgtaatcccagcactttgggaggctgatgagggtggatcacctgaggtcaggagtttgggaccagcctggccaacatggtgaaaccccatctctactaaaaatacaaaaatcagccggacatggtggcatgtgcctgtaaacccagctactcggaaggctgagatgagagaattgcttgaacctgggaggcagaggcttcagtgagccaagatcgtgccactgcactccagcctagtcaacagaacaagaccttgtctcaaaaaaaaaaaaaaaaaaaaaaaaaaaaaagtagtttagtggtgtctggtgtctgtgtggtgtcactaatagggaagtttgattaattaatgaagatacctgaccaataactcattaaagggaaataatccaaaagttagcactggtgttttgtgaccctcagactggattataattgtgctatagttctattaaaagagctactagtcagctgaaatcttacagtgtgtatccacacttcttgggatgcttttttcttttcaataattgtgttgttcttacaataatccatcacccttttatcataggattcagtcactaaaggaagaaatccaggcatattctaataaacacaatggtagctaaatgtccatcccaaggtatcatatgtgtgtttcatctatactgctgtatgtaccctgtattttctactctgaatacaaaatgacatctatgtgtattaagaattacataactaacaaggtgtgtactattttgagctctagcaagaaagaaaagaagaaggaaaaaaagaagttatcagtagtcagtatcttatgatttaagactccagggaatgtgagctagtgtgagagagtagcctatatagttaaaaccatggtttaaagacattataagatgatggtaaatttgcaattagtgtttcagggtctcctaagaatttgtacatgacaggcattagctctctaccgaagagggcaaaaaccatatagaagccttaccaagtgctttgatcaaactttattatctcttttttactgtcctcattaacatacttcaaaaacgctgttaagtatttctggcaagcagagcatcagagtaattttacagtagtgtaaaggatttattaattataatcttttcattagtctatttatattcaattgtgacattaataggttgccaaaacaaactagatttaattgtatttaattaaattgttgaaagtcactaagggtagtttattattattgtaagcagaaaaccctattgatgtacttgtttatgtgaataagatctggtgtaaagttctttctacaggatacggtattattcatcaacaggaaacaatataaaaatgctaagtcaagaaagttgtcatcataatagaacatttggaggcagaagaatcagatggtatttctaaacttatatccagtgttaggtaaatgaagtggggttcctgacaggacagacattcttgtctttctactatggcccctgggtaactccaatagtatctgtccatccttctttcctttcttggaggggctgttggtggggggaagggtctaagacacaggtcaaagtttcagtgaaaagtagtgcttcaaatatcacctgaagaagtaggaatgggttatgccaagagtaagggatggaatttgagtagcgaagaattctaggcaaagaaacttacattgtctttagtcaggaggtagaatgtgagaaaaccagaattagagaaaatcagaagaatacaagggaaaatgcattggtttatcatgaattaatgcatgtaaatgcattgagggtaggagaagacaaagtggaagctggctttgaaaaaaaatagcacttttctccttcaattatgtataagatttatatatatatattatatataatatatatatattatatatatatatataaaattaagatttgtattaagtgtttactatgtgcctggccctgtgctaatcattctatattatttcattaatccttatatttaccactgtgagaaagttactcttgtttttttttttttttttactttgtaccagtgaaggaaatcaggctcagagaggttaaataacttgttcaaagtgcacagttagtaagtggtaaagccagtatttgaactggggtaacctgattccagatcctatgctgttatagactacaacacagaaattttctctgccagtatcattagttttgtttgtgatggacagcgttaagatggaagtaaatgtatgtcaggatatgctaggtgatgctatggtaaccaatcagccccatatctttatgcatacttctttcttgctcacgccactgtctgccaaggttgggtgggggctgtgctctacattgtcttcaatccagaattcagagcagcatctttttgaaacagtgttgttcaccgtggcagaaaaaggagagttttgtaggttcaacatcaaataaatgccttgacttggaagtaacttgcatcacaactcactggccagaccttggcgtatggcttaacccggtagcaaggggccatgaagtacagttctaccatgttcctggaaggcagacagcaagagctatttgttgaacagcattcatgatatggccacaaaataccttagtggttagaaaatgatattttctttgtgacggtactctttcattcttagatatccaagcttagatatcttagcttatttcagtatttgttggatactgaaatatccaatgttgtatcagtttactcagtctataaagaaggcaaaagtgtagatttgagaagggaataatccagtgtgtgaatcaaaaaaataacatgacatcaagcttgttttgttttatttacatatagctgacttttgaatgaattgtcatatggcccagctcctcatttaagtaaaaatgaagcaaacctttgaggctatggaactttctttccttttctccatcaaatctcttcaccatagcaaatacctaagggtcttgcttgcttactctctcctgccctctctccaccttctcatttgtgaatctaatctgtgaactgattcccagttttaagaagaattgccaccttggaataaaaggtcaaagcattcaatactacactgtctggaatgctgctgtttgcttcagatgaaacttttatagggcatattcagtaagtaggtgatatttttatattatcctaagtattttttattctccttatttttacttccagaactgtatcgtttctagtaataaatcagttatggatcaaatgcatccatttgtcatggatgaatgcctatacatgccttgatgatgataggaaacaaaaccttgtaagggtggatgctggctttggaagaaaaaaattaatgaagcttggaaaacagtgatagcaggggacattgcaattttaggtgttaagtgacttattttcaaaccctacgagtatggcaatatttttcctctcccccttcctttaattaaacattcttgtagtgcagagtgaccccagctgaagaaaaattgtgttagggaaagttaggcttcctaagcgctgttatttaataaacagtctttcttattagctaaaatatttgccttgatgggcagggtacattgtgaggccaaaataagagaagaaaaaatgggaaggctagcctggtttaccaacacttctgtgtcacaaacatcaataccaagtgctgctttcttgctgatggttcaggaagatggcatttacatatcaggtttagttttgtgaaacttagctttaatctctcacctcccatcccttaggggcagaataaggctgaggcaattattctgtcaagattttaaaggactctctagaccatctccttaatgcacacacacacacacacacacacacacacacacaattatacattgttaaggtatttaacaatcatatttcggaaataaagagttggaagttgccttagcaaccatgaagactgtgctttcactggacacttcatttgcctcaaaacctcctctgtcaagtggttgttgattcactggttggattttctcccatattgttttggggcatactgaaattggggatgactcctttctctggcctgggcaaaatgtttttaattataaaacagatcttccctagtccccacacctattccatccatacctttcttcattgcagtgaatagcagctccatcttttccattccttactcacatcgaaaacctagaaattgccaactactgtcttcagattttacattccattcttctcagattttacactccattcttctcagattttacattaaatttattggaaaagctatctttctctaacatcatgatatattcagactccaaccacttcccaccacctctattgctgtcaccctgggccgagccacaacttcctctacgtggattataggggaagcctagggtggtctcttgctttcacctttgccacagtctatattctacaatctatatttttcacacagcaggcagatggtgaggttaaaaagttagtcaggtcttgtcagtcatctgttccaaacccacacacagtggttttattatttcagggtaagagtcaaagtccttgcagagggccctaataatatgccctcaacttttacccccattatctccacagcatcttctcctacttcactcttctttgctcactctcctttatccacactgggctccttgctggcccttcaaagataggcacacatctgtattcattggctcttgctctgtttggaatgctcttccccagatgtctacgtgatatacgttctccctgctccaagtatctgctcagatatcacctcctctgtgaggtcttcccttaccactttattgattttaatttcaccctcatctcagaactgcacatctccattctcctggtctatttttgcagtagcatttgctgcctttcaccttactataactcacttacttaccaaacttgtctccctccacaggaatgtaagttccacgaaggcagggattgtcatcagttttgatccctgttatgtcagagggcaaaaagaaggctcttaataaatatttgctgactaaatgaatgaataaataaaagaaaaatgtcaggaccacatgagatagagaccattccttttatttcctatcaaatctaacgtaagtatttacataattcctccacagccttcagctctttgctaaaaatgaaattcctcccttgcttcaggggccctggtcctctgaactgcatgactctttggtcatgggagtgagggcaggggttggcccacagacgaatccttgtgaagatgaggtgactggtccagcagcgggggaatgagagatcttttgctgctaaggctgatattatggccaatggagaaattccatccccaccgagagggtccattttctcccaatcgcctaacagaaatccaaatggcaagttactatgattttcaaacacagaagaattttatagagagacttttcagatttaaatgtccttttcttctgatgtaataataatacccaaaactaatggagcctttatcatgtactgtgccctaccctaagcactgcagacccacacccacatatatacatctgtatatattatttaaccctgacaatgacctgaggaggtaggaacttttattatcccagtttttcagatgaggagatagaaactcaaagtaaatttcccaatgtctcacagctagtaaaggacagagctaggattcaaacccaggcagtctcagtctgcagtctgtgctcctaactactgtcctgtatgttcacttctatgtaccttgtttctgaaaaagagtacacagttacctcaggaggttgtattaattcattcttgcattgctataaagaaatatctgagcctggataatttatataggaaagagttttaattggttcagggttctgcaggctatataggaagcacagtggtttctgcttctggggaggccccaggaagcttccaatcatggcagaaggcaaaggggaagcaggcatttcacatggctggagtaggaggaagagagagaggggggaggtggcacacacttttaaagaatccaaaactgagtatcatgacgatggtaccaagcagggatggtattaaaccacaagaaaccacctgcatgatccaatcacctcccaccaggccccacctgcaacactgggaattgcaattgaatatgagatttacgtgggacttcatggtgggcccttttctgagagtcttctctaagacgtgagaggtttactgccttttgaggtagactatttcaatactggagagttgaaattagacttttctcccaatatttagcagaatcctgaggacactggggctatggaagatgtggattgtttctatttttgtggcaggttgcagagccagccatctctcagtgaagagccatttagttgtaaaggcagttcctatgttattcctggactgtcccttttccaggctaattgtttgtcattggaaatggctcagctgtggcctaagacatgactggcatttgtggaaccccgatatttatttgaacaactcaaggtcacaataggcagctgtatcagcctgccaacttggattgaatctgccatcagtgaaaacccccaggtctatttcacacatgccaccgtgaagtcacatctccttgtctctgttttcacagcttgctatttgatcctaagtgtggactttaaatttgtctctgttattttctatcatgttagatttcaatcttccttccatcttcttggaaactttgaaaatgtcatttctgtcatctaatatattaactagtgttctcagcttaatgtttttgaatgaataaagaaacctacaagttaacacttaataaattaattcccaaacatgaattgaggattccatgttccaggaatgatgatatcatactaacgtttcatcgctttgtgaactgaagagggtttttggcttcttacatatgtaacctaagagatggaaatcccaacaaaaatatttggaaagatagacactctgggatagtttattctacagcagtatagttcaatagaaatatgatggacttggggaggctgaggcgggtggaccacttgaggccaggagttcaagaccagcctggccaacatggtgaaaccccgtctctacaaaaaatacaaaaattagccaggtgtggtggcacatgcctgtaatcccagctacccaggaaggtgaggcaggagaatcgcttgagcctgaaaggtggaggttgcaatgagccaacatcatgccactgcactccagcttgggtgacagagcgagactctgtctcaaaaaacaaacaaaacaaaacaaaacaaaaaagtatatatatatagctgcatctataatttaaaattttctagctagccacatataaagaagttgaacaaaaagatgaaaataatttaaatattatttttaacccaaaatactttattggtcttctatgactgctgtaacaagttaccacaaactgggtggcttaaagcaatagaaattttttctctcatgtttctggagaacagaagtcccagacatgaaatcaaggtgtcagcagggctacgctcctatgggaggctctagagaaaaatcccttctttgcttcttccagattcttgtggatgctgacttgtggattgacttgtggctgccatatcactccaatcttggcctccattgtcatgttacctgttcatcttctgtctgtcaaatctccctcagcctcactcttttttttttaaattttttttttatttttttgagatagggtttcactctgttgcccaggcgggaatgcagtgacacaatcatgtctcactgcaggctgaaactccccaggctcaggtgattctttctccacagcctcctgagaagctgagactacaagctcatgccatcacacctggctgatgtttgtattttttgtagagatggggttttgccatttgcccaggctgttctcgaactcctgagctgaagctatccacttaccttggtttctcaaagtgctgggattagacgcatgagccaccatgactggctagcctcactcttaacagaaaacttgacattggatttaaggccacctagataatcaagggtaagctccttctctcaagattctctatcacattttttttaaccacataaggtaatattcacttgtttaccatataaggtagtactgataagttctagggattaggacatggacacatctttctggaggctatcagcccactacaattatgtctacatgtaatcagtataaagaattattaatgagatagtttacttttttttctgtaacaagtctttgaaatctggtgtgtgtttaacactgacagcacatctcaattcagatgctcaatttttcttgaaaatacttgatctgcttttagattttataaaatgtacagttataaacattgattaacatacttgagttgtttcaaccttatttaaaactgttccagtaagtaaatcaaacatcagttctaaaatttaagttaaataaatcagtaaaaattaaaaattcatttatttagtctcactagccacatttcaagtgaagcctgggacctccttgtacagtggccagtggctactgtcttatattctgccatgatgcaaacgtaaagcccacttcaattatagcatatgaactataatacataaagtagcggatgtactcttacgtaataatgcctagactttaagtaccattaagtttggtaatttattctgaaagtattttgaatgccctcaggagctaagacctgtaaatatggtaataaacaaaatcaacatggtctcaacctcctggggttttctgtctgaatgcacattagtttcgttaccttgcctaagcctcagctgtcagaaattggtatgggacgatagttaagaaaaccactgggcaaatatatctgaaaatgcctgggtaagaagcctgcttagtctgtagagatcctatgatcagaacctcagtagaacctgatgttcaaccttctgtcaagtgtaagctgaattcccatctaaataacttttcttcaggatattaacttgatgttttgtaagatgaagaaattagagaatatacttaaaatatcatgagaataaagataaatggaaataaaatgggtgacattattaataatggcaaacagtaatatcacaacagtaaaacacattataaaaataaaaccagttcatgctttaaaaatttttcttttcaccagcacacacttgatggattttttttttctactttaagttctgagatacctgtgcagaatgtgaaggtttgttacataagtatatatatatgtgctgtggtggtttcctgcacccatcaacccgtcatctacattaggtatttcttctaatgctatccttcccctaaccccccaccagccgacaggccccagtgtgtgatgttcccctcctcgtgtccatgtattctcattgttcaactcccacttatgagtgagaatatgcagtgtttggttttctgttcctgtgttagtttgctgagaatgatggtttccagcttcatccatgtccctgcaaaggacatgaactcatctatttttatggctgcatagtattccatggtgtatatgtaccacattttctttacccagtctatcattggtgggcatttgggttggttccaagtctttgctattgtgaacagtgctgcagtaaacctgtgtgtatgtgtctttatagtagaatgatttataatcctttgggtatatactccacttgatggaattttaagccatctgtctatctctcatacagtatattttgcctgagaggtttcccagaaaagatgctgttggtttgctccttgtagcaatgtacccttaggaatagaaaggatgtcccctttttagtggttttagagagaccacaagtcagcttacttactactttacaagagtttggactcattaccagaaagaattgtaccaacaaaaaagaaatatcatggattttgagatgatcaagcttctaaaatatgttgctactctttggctattatacatcagtttcaagttttgggattgtttcctatgttaacttagcagttcttattcagaatcaattctcagccaatttttagaaaacaaaaatccttatggaagagaagagacctgaaggtttgagtcgataatgttttaatacaaacattattataaaaagataaatattcagtatggattggggcctgaatttatttgtattgagaaattgatgttgaattcatttccttatggggcatctggtgaccaatcttatatcccatctgggttcttatttcattctacaaacatttatgtggggtgctgtgccagcacttacaggtgccaaagaagaagatgaatcaaaggatactttatcacaaagcactcggaaatagtgggcagtgcttataaatgaaaaataatataaggcaagaagtatgtgctgagtaaaggtgtgaggacaaagaaagaataatcattccaatctagaaggactgggaaagacctcgtttgtggaggagatggccgggagaaagatgaaaatcgtcatttccatttgctgaaatgttcctatgtggcaggcttgccataaatcccaaagcctagcagagtggccggtaattaaaaaggatgattaatacatgaaacaagcaagtttaaaaattttgtttaaaaaattttaggcttcattgtgtgaacatccatcccaaaataacccagacatacactatttgtcagaaggttagattggatgacttctatcttctattattttttccgtggcttcattttctgttcaaatctagatattgcttgaatcatatcccattgtgataaaccaagccagaatcattgggacgcgttttttaatagttaatctgtaaattatacggatttgaatcttcttatagtttttccttctctaagctgcagtgtttacctatttacgtattgagtgcactgacatctaagtcttgatatttttatattctctgagatttctttgcacttttagtcttaaatcttaaatatcatgtaggtaccttcatgtttttttcagaccattttggtttttggctgcctgatctttgagaacaaagtaacagcttatctggtctatatgagattcattagttgaagctctcaaaagatttttggttttttcaaacaatgccttaaaatatagacaaacattttctctagatgagcaagtgtactaaagtatggagaagaaatgtgaaagaaatgtactaaaattatcaaatgttggtatatttagtctacccttgttttgatttcatcatttctctcctctttccctctgactctcatgccatataaattctgggcatccagccctcacccagagctcatttcaactcactcacatatccaaaagaaacaccactgtgatggcaaaaattttagaagaaagtaagactttgttgacagactcttgtagaggtagtgcaaaaagaattacatcctagaacacagagtgagaatttgctgaaattctcctgtccatatctcagtctgtgtcatcttccatgttcatccagactccaaaccactcctttcccactgcctggttccacttcccttcccactcctccttctctctggctctgctttttccctcccagactcctgtgtctgtttccttcagtggaacctcaagccgtttcttgtacagaaatcagttcctcttgagcttcaccctcatatcatcctgtccaggaaaacaaaaagatcttccttaggacctacagagccaagaatctgggggaaagtcaaaatgtgtaaactaatgatttgctcttgcgcttttcagttcttttcaattcttttcagtacttgcttcctactcctgttcaacttgtttcttctcgtcacctcccaattcctcattctcttccttcctatgtatgatatcctttcatttcccccaaaattaagtcagaagcaagaacatttatatataaatggttgaaggaaaatatatatactcaacagtcacttaggaaggtaatacctagttgtgaaatacaataatgaaaaagtggtcaaattgccttcaattttccacagaaatagataacatctctggtaattttccacgtttttccattgacctagttgctatttcattgtataaaagtgagcactcgtatttttctgtacctgagctttcatactcacttccttttctgccaacttgctcagctgtttcgatcttcaccttctgtctgtcctcacagttggggattatactttgactttcaacacctgacatatctggaacattctacctcaaaaaagtcatttatctttatatcctttaggagcattggattataaaggttgtactttttagttttattttgtatgttttttaagggcattcacaatgcaagcatttagcttctgacattgatattttctttgcattatgctagacatttatcgtttaaacaagaacattctccatccaatttcaatgcctcctctgagagcattgtacttttatatgcatgtaagccaatgagatatgacaaatatcagtttgtgattttctggattaagtcatgctagatatttacttattaaggaatggatggaatgaaaaaaattagcatatgaagtattttttaaagcagacagtatttcttcttttctgtaggaagaggaactggaatatatgttttccccatcaaaaaatccttattagaggacatcattatctgcttataaatgctggaaatacaatttacaacctcctttggatcaaacatgatgaacaaatagacacatcatttgatatcccatatcacctttcacttaggagtttggtgtacttttcagatcagttcatttggaagaaatatggacaggttacaggatcaatgtgaaataaatgagagcataatcacactgtaaggaagcaaagctgtatagaccggagcaaagatcttcattgtgaaatcgctcttcacctttgacctacaaactagagacagtggtgtcttctgcaggtacaaaattgcctacttgctacccataaccacctccagtgtccatgacctaatttatagattaagctaaataaatagtaccttggacttgtgaaagaaaaaatgacccatgtgattttagcatgaaaggagactgagagtccctggaatgcttcctttacttgctataggatgctgttaactatgatgataatgacaaatgtaaacataacagctaacatgagacacttattctgtgccaggcactactctagtctccttgtttgtataaattcatttgatcctcaccataaacctataatgtactaccattactaacttcattttacttaagaggaacctgcagcacagctcttcataacttgcccagtagtgtcacacacttagcaagtaagggagaaggatttgagcccaagcagtctgatttcagacttcatactcttcaatgttagcttaaatggactctattgtgacctagctttcagcaggaagcataaaccagtgtctttacaaaatgctgatttctgctttagtacttgtcttcctttgagtggacagtgaagaaattgctattgccctttcatgtccttgcttggtgaggaggaacattttctgttccacagtgtagggactcttctgtccttgtctacctgacagtttggaggagaaagatactgggaacactatagattggggaggacaggaattctgagatgaattttgggctggacacgtgctggcaaatgtgatactattttagaaaggggaaattttaaaatttcacattccaaaccagatatattatctattgattattggttatgcattcatccttatatagtggtgcccagttgggtggcatcttagggcttgctcacaaattcttctaatttccacctgaagatcctggctttgggtcacctgcccaatatttacagatagggctgctcatccagtggacttttatattccccctactttaccatgtcaccactttggccttttaaaaaagtcaataattgtaatttatttcccagatcttgtcatctcagatttatttttaagaaacaaagcacccctctgatttatgatctataattagacttttatttccagagatctgtgggccaggccagcctgtggtcctatcagctcaatgactgctgtttctcacacgcaatgttgaggcatctctcactcagcacaaacctattttgctaatagtcatatactctgtcttctcaaacccaaggttctgtgtatattccctcatacttttccttaggttgattaaatatttaatatatttggttaaaaaagcctctccatttttagtatatcattaatactaacttattttataacattatacatgattattatctgtttaagatctcaccttctatttccaagtatctcatctaaaaaattccgattagaatggcaaaaataaaaaaattcctgagaatgccaagtgctaacgaggatgtgaaacaattttatgggaataaaaaatgacacaggcacttcagaaaactggaagtttcttatcaaattaaacatacatttactttacgatgcagaaatcccacttctgagtattcgcccaaaagaaatgcaacttatgttcacacaaaaaacatgtgtgaatattgatagaagcgctattcaatcactaggaactgaagacactccaaatgtcctttaatgggttggatagataaacaaactggtgcagccacgcaatgtaatggcaataaaatggaacaaactacagaaacatgcagcaacagggctgaatctcaattgcattagtgctaagtgaaagcagccagacaaaaaaccacatgattccacttatgtgcattctggaaaaggcaaaaaagggatagaaaactgattagtggtgtccaggggctaaggttgagggtaggcattgactacaaagagtcagtgtaaggaaattctggtgggaaggtgatggaaatgctccacatattgggatactggctgtagttacatggctgtgaatttgttgaaactcatgaaacagttcaccaaaaggaaggaattttacagccaggcacgctgtctcactccagtaattctagcactttgggaggccaaggtgggtggatcacgaggtcagcagttctagaccagtctgaccaaaatggtgaaaccccatctctactaaaaatacaaaaattagccatgcatggtggtgtgcacctgtaatcccagctactcaggaggctgaggcaggagaatcacttgaacccgggaggtggaggttgcagtgagccaagactgtgccactgcactccagccttggcgacagagtgagactctgtcaaaaaaaaaaaaaaaaaaaaggaattttactgtaagtaaattttaaaatagtgaataaaatatacaacaaaaagatcccctggcatcatttataagttgattgcatgttttgcctaaagtcgtagagcctgtcacctctctttcaagttgaggaaaactctctctgagcccaccaattcctggatgtcaagtttggctacaggtgaccttcagagaaggcttggtaaatccatgtgaggttagactagttgcacaattactggtgaaggtgggtcccttaactctctcctatttatctatctgccctgcccccaaatcttggccactttctaataaatattacagcttgaaggctactctgtggatctccaaagagatactgacttcaagggcaattcctctcatttcgttgccagggattttgaatactttcttgccacattgatattcatttgttttttcatttgtacaatcattcacttattgagcacttatctaacacttattgagtgctaagtccctcaccaggaactaattcctgctctctgagacccatagtctagtggagcagacaaatacgtgattgttagctatgtcacgataattgcagccatgacatagagctatgaggagacatagcttgggagaggtcagggaagaatgtagaaataatggtagctgtgctaagtcttgaagaatgagtgcacttgtttccaggcagagaagggtaggagaagggtgttccagacagaagaaagaacaagtagaaaggcaatgggcatgaatgagcacagtgtgtctagagaaacttgaggagtgcagaactgcaggtgggtgacctatgaaggggcttttgtctggagatgacgccaaagaggaaaggaccagatgtgcagggccttgtgtatcatgtcgaagaatttgtacttttatcttagaagcctgtaatgaagcatccacaaaccatgggtcctatatgaccctccccaagcccacagtcttgcttcacgtggaaagattagaaagttaccttcttgttgctgcttttaaaaaatgtctaggtgttaatattttatgtctaaactacagtttccatttttttccaatgacattcttttactcaataaagtaggcaatccattttggaagaaatacagttcagtaaaatgactttcagttttagtggaaaaaaatcagcctataaatattttaatcttttcctctggtatgtggaagggatctttttcagtggtttctgcagggaagagaaacagtaagatttgcattttagagagatcactccagaggcaacgtggagagagaaggtctctggcaagatgcattctactgctctgaaggcccaatttaagcaaatccttttaaagcatcttttggccagacaggacaacaggaagaaaacatattttcacggcatgccattttatgcaagtgggaatgcaatccaaagaaaattgtgtgcgtgctctctctctctgaaacagagaaatgaagaaaagaaagacaaagaaagccacaagacaactttccatagattgcataaaagcctgatggtatttaaattattatattataaatgattctctgctgattgtaccattaacagaccacagatagaagcattaggaaatcacagggcgatgctgaattttgtctacagtatgtgtagtttaatggactgtcttgccttgtagaattctttatcgtattttatcataattttaatgactctcattgtcatatttcagaacaatgagtctgaaaaatcttccttatgattttttagtgagtcactttgggaaggtgatgatcaagaaaaaagttggaaaaattgagacagattatcaaaacctttagaaagtcaagattttgtgttccaggaatctttagtcaatgttggtgggaaggtgtaatttcagggtaaccaatcaggaattctgtatcgaggtcagtgtaacagtttgtccagtgctttgcagaacctgtcttctttcctggacagtaagctgtctgaggctagaagccacgttcctctctgctcacagctgaatccatagtacatggcacagagcccgaactctagcaggtgctcagtgaatgtcaagtggatgtataaatgatgcctgcatggctgcagtattaatctatagaatctagggttcagggtagtcacatttgctgaattataagcagtttaaagtagaagctattgttaaaaaaaaaaaactttaaaaaaactatgcaggggtcaatactcgtcagaaaagcaatgacattaaaagtaggaagataaacaacaaccctagtttcttagagatgtttagccaagatgtttttgaattcatttcactacaaagagatcactgctgttatcatttcattatgtaacctctcatcttgtttacaatgcataactctatgtgagtgtttattttcataaaaagggatgctattgtatgttcagttcagtagcctattttttctactaatctgtcacccatatctgcattttaactcatatgtgactttcactgtacatgatcctgcttcagtatcttccttctctagtacactataaactccaagtgggcaggggctgtgtctctcttgtcctctgtctacatccaagccctgccatctgctggtccccatatcagcactagttgattgatggctactgttttgtttgtattaattgcatagtttcttattctctgaatatagcataattcatttgcttaatcttctattgttgaaatcttagattttaaaaaatgtttttctccagagtattcatagatgattttactcatattaatattagcaattatgcatatttctaattgttttagtaattattatagaataatacatgaatataatcaccatataaaagtggaaaccttatggataagggacaagtactctttaacaatcaactttctgtgcaaggagagtcataataatcagtttgagtctttttaggtcgtttctaggcttttatataatatatatgcactaagaaaatgtatgctattgtacatgtgtgtattttatacgattgatatgatgtcattcttattattctgcaaatttctctccagtcaaagattgtgtagcatttcatcttatagatctcctatgatagacaatctcttatatttcttactattttaaaccatgaagagtcgcattaccccagatgcagaccttgaaacaaggatttgagtcaggtagtttacttggaggtcattgatgatctccagagatacaagtgggcaaatgagacagggaagggaaagcaaccaatatgtgttgcttccataagtgagttgctgatgcagacaactgagactcagttttgctggggctttctgggggactgtgaaggacatacctcagagaagtcccattggaggggtgaataaaccagggtattaacccgccaactccagcacattggctggggatgctcccagggctaatcactccatacatttctgatctgccctgtgggtgggccaaacacatccctgcatttatgttcatagaaagtcctccagcagtcacagacatgcacagtaggaagctgctggtatgtggaacgacaccttctgataggatatggacaggacattgagggcatctgctataacattgttttgtgtttatggctatattttaataaatatttttgggatgatattcagattattcttttaacatttgtaactggaccttaagtcttggcttgctgtgtttcttgagaaaaacactattgcaaggcaattttactcacctgctccatcgttcagtcacttgaaactgctcctattccctttaagcctcccctcctgctgagccagccaatcaccttaacactctctgactgtcccataaacaaatgaagtctgtctctctgtaaccttctctcaagggagggtcactgctcctataggtggggttcaactgagtagagtcaagaaacctagtctctgatttaatgactctgaagctctaatgtaaactctgtgtccaagaaagtgcctatattaataccgactaaagagaatgtaatttttcctggtgctctggtggtgggactaatgatctacacttatttcgagaaggttgttaaggtttcctctagtccagtggctcaggaagtgtggtcatcataccagcagcatcaacatcacctgaaacctgttagagttgcacattcctgattccttccttcctccttctgccagacctactaattcaaattctctggaagtgagacccagcaatctgtttaaaaaagcccttcaggagattttgatgaacactaatgattgagaatcactgttctagccttttataatttacatttatcccaattattttgttcaaccaatttttacaaaataaaaagttttgagcaaagtagtaaattcctttctgtttcaaaactttttttctttaataacacatacatcgccaatgaagattccagtgctctcagtccctgcacattcatggattatgcaactctaagatacgtaacattgtcttgaaaattgcattaagacagtgcctctcttctgccaaacatcaaagattattgcaaatgtacacattaattatcttatttgcaattaatatggctaataattataaaggcatgtgccttgctgtaaataaagacataatccaaaaacaagaaaaaatcccttttattccagttgctcttcttccaccttgtatgattgtttacattcccgaaagactctgtgttgagattcttttacatgaacatatccttcttgcatgtaaaatgacctgattaaaaataatggaaccaacaaatttgggttaccaaaattcagtttttgtactctccaagagtttatgcatggattaaagttagagaacacacatatatgcctttgagttgcaatggcaacattcttactgagaacattatgccaatcatatagactatttcatgcatctttgctccatccctgtaaaggacagatttttttttctcccattttcctgatagggataactcaaagtggagaagtttagaaactgaacctgggttgaaaaggtttggaaactaatactttgctcattttttccattcaggtattgaaaactctttattgagtgtctgctatgttaggcattgtgctaggtgctggagctgtgtggagaagcaggacagtcagccagagctttcggtctagaatgggcaaaagccatgttctctaggacttttcccactataaaccagagttttctcaatttcttcacctttgattcgaatgtatcttatctacagtaaaagataaaatttgggttatgctggtgaaggaagggcatagaggacccaagaaggtatggcttgtggaacacaattctttatttcctatctgagctcttggttcttcacataccatggcttgaaaatcatggacctggagtagagattgcaaacatatcttacaaagagctttggctggacaccatccgtgctgttatcatattgttcaacaattttgcattatttgccaatagttttaaaatataaaaaaatccagattttctactttaatgggaaaattgacagacctggccacaatgagccttctttttctcatgactgacctccattcttcatagactcctcacccctccactttcagttttttcctaccctaatttgcattacctgccttgagcctgtagggtactgtatttatagacataactttatatttgggaaactaaacaatatagaatttccccagtgtttgagacataataattctttacatttgtctagtgattacatccttgtgcattatatctagcagatattgttttcaattttgatcaatgaaaacattaaactttatatattgctgggcacagtggctcatgcctgtaatcccagcacgttgggaggccaaggtggatggatcacctgaggtcaggagttcaagaccagcttgaccaacatggtgtagccctgtctctactaaattaaaaaaattagcttggtgtggtggcacatgcctgtaatcccagctacttgggaggctgaggcaggagaatctcttgaacctgggaggtggaggttgcagtgagccaaggttgtgccattgcagtccagactgggcaacaaaagcaaaactccatctcaaacacacaaacaaaaactttatgtattatatttaaatagagcaccaactatagctgtgcatagtctatgtgtttatgcactaattttcatgacatatcttagaatggtagtatttttgctactgttttatagttgacaggcacagaggctggtgactccagttcaattcctcaaaccttcaagcacacattaattttcattttaatcaccatttaaattgtgccattcttttgttttgttttgttttgtttttttgagacggggtcttgctctgtcacccaggctggagtgcagtggcacggtctcggctcactgcaacctctacctcacgggttcaagcaattctgcctcagcctcccaagtagttgggattacaggtgcccgccaccatgctcggctaatttttgtatttttagtagagacggggtttcaccatgttagccaggctggtcctcacgtgatctgcctgcctcggcctcccaaagtgctgggaatacaggtgtgagccaccgtgcccagcctatattatgccattctgagtttgtatgttaacagaaagagagtacactgctttatgtaaaaaactgacaggtgattgccttttgcttcactctttgttgagtgattctgctgctacttacttaaagtagaaagtggtgatactggaaggataaaagggactgttaaaattgtctttgcaataatttattatttttgttctttataagccacctaggtcccctgagcctctgagtttttctataagggatggaagaagacttgttttaaaaaaataattgaaagattaacttgcttaattaatttcctttaaaagtaaagaactatgcaaatagaataaagaatactgctcagaagccacacatgaaaaataaagaagtgagtccattattcatagaattttctatgagttctttttctctggcatctaaaagtgaggctggacttttgccttttttccctctgaattctaaaagaggctaaggctgcttgcaggatttaaacattttttctctcctagatttctttcttcccaggtcattttacaggctcttggatgttgcttgccagagtcaaaacctgcctgtgttgttgctgagggcatttattttgaagtgggctatttctaggaatgcatgtaggagtcttcaagaaaaattcatttctgtttttttttaacttattttttattataccttaatttctagggtacatgtgcacaatgtgcgggtttgttacatatgtatacatgtaaaaaataaaaagaaagaaaaattcatttctgttttctgacctagaaccccctgcccattatcccagccaaccttttccactcagacaaaaaggctaggaaaatcacagtcctcaattttaggattctactctttgaagacccaagtctggtaccatgtttcacaaacatactgtgtccttagatttggatgagaaccctttctgttacttcattcgtttgttccttcattcttctttcctaattcaacttctctcctagttcagactcttaaaggattatgaacttctcccttgcaggacttactgcaattatagtgttacatttatttttaattcttctgcttttatctctggcattttaactcaatgatggtagggacttttgttcttttatggtttgtcactgaaaccctagtgtcttacaaaatgatgattacatatctgttgagtgaaaacgtggtaagcagcttgtgttgtccatttttatggctctttgttttgctcagaaaaaaatctgaactttctgcagtgacctaagaggccctggataatcctgcctccagtcacctccctgacttcacctcctgctgctttccctcttggctgtttcactccagcctgggcctgggttctcccatggtttaaggaaacagatatattctcttcattcaagacactgaaaacaatttcatcttcttacattgatatattgacattgatagtcaaataggagatgaaagtagagagagagaaagtgtgctactaaagaatgaacatggaattttagaattgggccagaattcaaattatggtccagccacttgctaggtgttagaccttgggcaagtttcaaaatttttctgggtctcttctcccagtctttaagatgggaatgataatactgttgttgcagaaatgttgtgaggattggacataaagtggcaaaattactgacatatagaagttaattgatagtaattattatcacatgttcatcgtaattgtatgaatcggctattgctgtgtggaaagatacccacaggaactcagggcttaaatagtagcattttctttttctgcaggcctctgtgggttgactgggggcacctcagctgatctcagctggctcacttatacaactaggagtgtgctgatcttggctgggagtttctgctctgagtcgtggggccagttagctgaggtctgggtctgctccttgtgtctcattctctggcctaggtagaagggcattagctatccaaatggagctcttctcatggcaatggcagaggagcaataggggaaaaataatacaagagacctcttaagacctaggcttgaaactggcacaatgtacctatccctataatccattgaccaaaaaaaagtcatatgtgcgagtccaatgttcagaggtggggcattacattttcttttgttagataaactacaaaggtatctggcaaaagataagaatacaggaagagctgaaggactgggaccaataatgtaatccaccatagttagtattatagaaaattagatacatagtcaggaaatgtgggctcttctgcctttaccacaaattgtgcggccttgggaagctcctcctgtaagccttggtttcaacatctgtagaatgatgagattctgctactagatatatggccaatgggcttggtcttgagacttgagtcctagtatggagcgactgggaatagtcaccttgcattctttaaggacaaatacggttctgagcttgattgattatgtctagcttgggcactagggaagggagtggtggcacagatgatgtgtatgtattattctgtgactagatgatttctttagtccttttccactctttaatcattcatttcgttatttttcaagttttattccattttgaaaattaacaaagggaacattcttaggctgaggacactttgtactttcgaaaagactttattcataactgactatgagctgtaaataatctgaagtagcattctagtgatattgtcataaattaattactaaagttttgggaattagcttagtgacatgttttaaataatttgcccccctggaagtatctttcccctaataggtttacagctcctcttagatttacagtaattccttcatttttctcttatctccattatttatgtaagccatattcccactgaggatacttacttttgcaactgcagtgttggatggaatatagtgattctggcggcggttttcaggatttgaaacaaatccatatttttatttagtttctgtactacatgaaaaattggaacacaggtctagatgattttttttgtattgctgcctatattgataaggttatatttaggtgactctgattgtaggagtataaaataatttatccttaaagcaaagacatagttaaccgacttctaaatgtataactatttcattaattccagaaaatacttaatttcaactttattaaaaaatttttccatgatgaatacactctctcacagttgtgctgctaagtttgcaatgatacattttcaactttttaaacaaatgtttggctgtaagaatcctagaaataaatcagcaaaattgtccagttagggtccaattgtcttattgttaagatcaatgttgggtaagttgattctttgatgataaatattgattgagtgcttactgagttcaagcatcatgataagggtcattcatggattatctcatttaattcacataacactttatatggtgggtaggccaactgaacttataagtagatagagatttggagaggttaagtaacttctttggctagacagtcagctattgatagagttaagacttgaacacagcctccagtcatccccagagacctagctctagatcctgaatggtactgtacatgctgctgtactgtatctaagataaggttaagcctgatgatattagtttatcctggcaagtattatagtatcacataaggcatattgattttttaaaaaaccaagtatgtacctcttgcatcagaagttgttagaaatatgcaagcactgtgtttaatatttgaatacagcttttgcttcattcattatcttagtgtgatatctatgaaaaactgttttaatattgaaagtagttgagctttatctgctcaactgttctcatccccatgagggtaggcaagctacagatgctacacatattatctttataaagcaccgacagtgagagcagtttttctttctttagacaagtctaggatcttatgtggcgacaatagcacatctttcagcttaggaaacttttatacagattctaaatatccttcttcagatgttgacatagacccacatacctggccccagatatgaaataattctggaacaaccttccagttgaaataaagctcacataaaatatgagaaaaatgcataaattcaagaaggggctcaccacaaagggatggcatagcagccaactgaattttcacagaagggaaagtttattttatatgggtagcagccacttttaatgaagatgggaagccctcatctctgaaatgaaccagaattaatgggatctattctttcttttggaaatgccacataatttcactggatccagctgtcaaggagaaacacccttctctgttaacagctgagtggattggttacactatttggctataaggaatagagactcaagttattgtaagtaatgaaggggagggatatattggcaatatttacatctatggaacccaggagcacaacaacctgacctgaagaagacacctgccaatataatcacccaatagacacaacaacttttgccattaaaagtaatggcaaaaatcacaattacttttgcaccaacctaataggtatgatagctgtagagacttcagaaattttagaagcttctgactccatcactctcctacgagagagggagactcaatcactgcaagggccttccagattatgcgaatggatgaagttggccacatgcttgtaagggatgatgcttacagctgcagtaaccatcttctgagcaagaggaggaacccaagcttaattgtagagaaatcaacccagagcctagacatcatggaatcatgaaggtaacaaaccccagaactgcctgtttcctttcttcctgctttatgaaatgtaagtgctgttagttgagtactctgtttctgacaagtggaaacattcttatactccctctgcaaatcattaatattaaataatataatatctatgattataagaatgtattggggaaaatagacatatgtggggttcatgaatattgaagacgggcttatggcagggctgtcatgtatagttggagggatattttcaaattagaaaaaatttgtgggtaagtagtaggtaaatatattcatggggtacatgagatattttgatatgggcatacaatgcataataatcacatcaggataaatgaggcatctatcaccacaaacatttattctttgtgttacaaataatccaattataccctttaattattttcaaatatataatatattattgtcaactgttgttattctgttgtactatcaaacactagatcttattcattctccctttccatatttttgtacacatcaactatccctagtttccccttctccccctactagccttcccagcctccggtaatcatcattctactctctatctccattaaatcaattgttttaattttttcagctcccacaaataaatgagaatatgtgaagtttgtctttctttgcctggcttatttcatttaacataataacctcccattccattgatgttgctgcaaatgacaaaatctcattctttttaatggctgaatagtactctattgtgcgtatgtaccacattttaaaaaatctattcatctgttgatgtacactgaggtttctctcaaatcttggctattgtgaataatggtgcaattaacatggatgtgcagatatctctttgatatactggtttcttttctttggggcatatacctagcagtgggattactgaatcatacggaagttctatttttagttttttgtggaacccctgaactgttctccatagtgattgcacaaatttacattatagctgggcacattttttactgcacatttctagggggataccaatcatagcctacaatgtataactatatgcagtggctttggcttaattactcattttctctaagactgctgaagttcatagaaatttccttttttacaactcataggctattaaaaggaaataaactctaaatctttgcctacggtgtctagagtgtctattgaagaaaggcttttctccttggggagcagctcttgctcagccaccaggtgtctatgtgacaggcagaatgatttcagtgcctctcattgtatgaggattgtgggctgcagatgaagaattatggtagctgtctatcaatcaagtgtgtgggtttttttaatccctgaagaaaagagagtgattatttgtttgttttccaacactgaagaggagaagaaatgtcatttgtgttgcttggcacacatgaattctgcatctcagtaatggaacctggacagaattgtactactatcaggcctggggaaatggtagccctgataggttacttggagttggagggaatatttcccaattgaggctggtagtggagcacaagcaaaggaggtgtacagatgttaatttctacgactggagagaggaaagtttccctctgtccctctcacttgtctggcaacacagaaattgactgccatcataacagaagctctgtcctttttaggtggtgaggggaaggagcagggagagaacattttctgcatattttttttccaccctcaaatggctttcatcccgctctgaataaactcccaaagatgttgttcatgattatgcgtttatcctgctttgtagagaaaggggaacagtaatactcagatactcccataaatggctgttctgtgggagtggtgtggataagaatgtggactctggagctagatgtcctggctcacatctccaattactagttttgtgactttgtgcaggttacataacctctctgggccttagttttcttgcctgtaaaaatggtgtatcgtagtttattccctcagaaacagactctgaaacaagaattcaactataaatagttcctttggaaggtgatgccaggaaacatagattgggaagtgaggaattacagtagggaagaagaaaaaaccattgaaggatgtattagtaaagcagttaccactgtgaggatgtgggtactcaagagagtatagaagagcccctgagcaatgtatcaccctcagactctttgaaggctgcatatgggccatttatgctatggcacttgccacttgtcctgtgtttgcatccaatgtgctcataaggcgaggaaatagaagccctcagggtgtagaagtgaatgctgaggggatttggctggggatttgggctgggcaccaccatcgtctgctatggcacgtaatgatacttcactgagttattgagaagattaaatgagtttgctgataggaatgtgtacaaaagtacctgacatatagtaagccctacctttgtgctggctgcctttcctattgtcctcagcagagccttatgggtaagagcctcgatcccagatagggctggattcaagttctggctctgccacttactatttaagaggccagattttcagcttctaaagcaagggtcagccattgactaacttttcctgtaaaagtccagagaataattatatgtcatcttagccagccctgctatcgtgactgctcaacttagctttttagtgtgaaagcaaccaaagacaataagtaaatgaatggttgtggctgctttccagtaaaacttgatttgctaaaacaggtggtgggctggatttgacccaccagccactgtttggcccataagccaaagtatcttttcctacagctgcataatgtgagaacaaacagtgtttacttctcagcacacatactaaaagtacagtctatgtcaacctgcctggtattgtatctcagcttgatgactttctactttggcaactatatgcacacatttattattgttaaccatcagttttctcatctaaaatagggatgataaatatacctggctcgtagggttgttggaggagatggactgcataggctaatccatatgctaggcttagagtatgtggattacagaagaagtgaataaatgtttctattatattcatttcaatttctactattattgtgctttcttcctggcagaactcactgcaattctattggagaaaagacaacagaatagttcttaagattcttactaagaatcagatctggcagagatatttactagttaaaattgaataacctattagaactgcatggattcggatcagtggttattaaccaggggcaattttgccacctaggggatatttgacaaagtctaggaggttctttggattgtcctaactagggaagagtgggctactggcatgtcatgggtagaggtcagtaaaatctaaaaatcctttaatacaggacagttctgtacaataaaggcttacctggctcgaaatgacattagttttcaggttaagaaactctcgtttagattgtatatatcacttctgaacttttaccctctaatatatggcactgtttatatcatagtatttcacatgatttgcaaattatcatcatgatttctctgactcacaggctttgaaaagatgtatggaaatattttgtcaagataagtcaatttaggtgagaagtgtttttttttaacaacactatcgtttaaaaaatacaccaggtagctagctgacaaaactacataattaattttcttctaaaataattttaaatgttggagagtctttttaagaatacaaatgacattctttgcattctataatttctatgaatataggacaatttgagaagataaaggacagactccagaattcctcatctttgttgtaatttaaggaagtctttttttccataaattactaaggtgtctctgtcaatgaaaagtgtgcaaagctattatttacacctgtttgactctcaatattatgatttcatgatttttgaaatggaatatccccattcaaaatgctttctgtactgaatttcaccacactggagtgattgttaatagctctttgctgtcaagaaaccaccatgacctcttctttctcttattttctaagtattgagatcttctctcaacttgacagatgaatttgctagagaatttttattaaacaatggccctaaacaggccatctccatcaaaccatcccttctcaatggcactcttttttgttttggtactcaaatttcacctagatatccccaggttcctgtgactactctgagtcctccaatgtcctcacaatgtttttaaatcctcctctaacccacgtggaactttggactcattaaagaaagaaatcctctgagaagatacatctcataaattaggacacagaactctgattgggagctcttgatcagcgaacaacttacactcttacttggcatttctgaaagttttatactgaagctaggtatgtcccctggctttacatcctatttggacatcttcattcactttatttgttatttcatttgttcatttcttcactcaccagcaaatatttattgtttccattatgtgcctggcacgatattgaataagacaacatcctctatctgactcacttatgaatattgtgtctagtgttaaaggataattttcaaaaaggtaaaatcatgactcccacaaatacaacatgaacacatgtcaaagatttatgtgacttactaattaataaggggaacaggaagagtttataattggttcaaattagaactggatttacaaagatttataatctctactggacaatattcattttcactgccacaagcaggaataatttgccttgcattggacaggaaatgtttacttcactgacaccatcagcaatttaacttctttctcctgaaagacaatcaaaagtgtgtgggtacccagtgaaatcagattacccctggagtatctgttaaacttcatccagcattctatagcagtcatttctggtccatttcaaagtcttcacgactttttctaacactagcacagacaattttcaaatatgaacattgcagatatgatgagtccaatggcagaaataaagtagtgtgttgggaaacagagtagttggtgggggtggggacttctttagatggaggagccaaggagaactcccctgatgattttttaattttactccccataggttgcctatttaaatcttaacagatgtgataaagaccttaatctacatgtgacaaatgttggcatttaagccatgagcatgaactacctgtagagtctgatggtactttttctagtaggaatggaaacaaaatcaggtctacctactagatactctctttacatttctcctccaaaaccttgacatctgtattttaatgtatctatttacttttatgcatgctatggaatctgcctctgctcttcattttgataacattgcatttcacagtaatttgtgggatgtagagacactcaaacggcaaattaagcttccagcaaagcagagccacaaaaaaatgagaaatcggttccttggaaaataattttagattttattttattattttttagagatagggtctcgctctgtcacctaggctgaagtgtagtgatgcaatcatagctcactgcagccttgaacttccgggctcaagccatcctcctgcctcagcctcccaagtagctcagactataagcaagcaccatctcacttggctaatttttaaatttttttgtagagatgaggtcttactatattgcccaggctgatcttgaacttccagcctcaagtgatcctcctaccttggcttctcaaagcactgggattacaagcatgagccaccatgactgacctacttttacattttaaaaagtatcaaaatagccatcagagaaatcacaagttttctggactccccttcacagatatgaagttttaatttttatgtgcactagcaattggcaaactatgttgctatagtttggatgcttgtcccttccaaatttcacattgaaatgtgatccccagtgttggaagatgaggcctagtgggaggggcttgggtcatggagatggacctcttgtgagtagatgaatgtcttccctttgggagccaggggtcaggggagtagggagggtagtgagtgagttcccactctattagttcccaccatagctggctgttaaaaggagcctggcacctcccctcctctctctccatgtgatctgttcactccagctccccttcaccttctgttgtgagtggaagcagcctgaggcccttattagatgcccaatcttctaggcaacataactacaagccaaataaaccttttttctttataaattacccagccttagctattcctttatagcaatacaaaatagactaagaagacatgtggcctgtggaccaaatctgatgtgctgtttttgtgaataaagttttcttgagacacaggtacactcattcattacatattgtccatggctgctttcacactacaacagcagaggtgaatagtcatagcacatactgtatggcctgcaaggcctaaactgtttactatctggtgctttacaggcaaagctttgccaacctctgagtttaattgattggggttaatattattcattcatttgtttattcatctatttaacagacagttaacaagtagctaccatttgccagacactattttaagatctaaggttatagcactagttacattattagacaagtttatgatcctcaatttcttaatctagtactacgtatgtttgtcttttatttatttggggtagactatgctctgaagtttttataatgagatatgtacctctatgccttggtttagggtctcccacaagcagaccttcaggcagttgttttggtggaggcatcttatttggatggtaagaaaacatgaacaggagtggggaagtatgaaaggaaagggaaggcagtcaaaaaagagttaattaccaagccacctgccatagtgcgtgatagaaacttaatcccctgaagaaactctgggaaatctgtaaagcacacaactcagaaacacctcacctaagggctgaggagcagaggaatttataatccaactcttaagtgtcatcggtagatactcatgtgtgtgtatgtatgcggggggcaagaggtgggatggtttgattctttgtttgccttgtatggtgaatgcctccatatcaataaactccattacccagcactatattttgctcccttcccctaccccaagggtacagaactctcaaagttcactgccacacctgttttcctagtttcggtagctacctattaaccagaacttgaaacacagttattaaataattctttacttcttgaagcagagtaagtgcttccttactcaagccatattagaacgtggggacagatcttgaggaaggcaagtatcatctcccaaggctgcctcctaggtgaagcttctgcttggtctcccagcaaggaaaggatgctatattctaagaataagatgtagataacttctgaagtctcagagggttaaggagaatctgagagttcaagagtctggagtgcatttacacagatgtccctttccctggacatatctcagggttttccatcttctttatctatgctctgccttagaatgttggctggggctgttgcttcaacactctagacagttctctcacatcaggtcctagccccgattttcagcctgatcttttctctgcctgcagaagatgagagtctctttaaatgatgccggagaggcctctggctttccatactgaaccctgggttggtgttcagctcacttgagcctgtcattttcttctttcagctcattgatggtacttggtccaactatccaattccataatctttccaatggccaatgccaccctatctctcaagtgctagagaaattgcataagctagtgcatcctcttccagctgtgccccatcccaattcaatcttaggtaagagtctcagcagttatgatttcatagcacaccattccactcgtgactagcaatggtaattttgttgccattttgctagtttctagctgcaaagaccaattctagagatctgtttcctaggaccactttgagttccaacctgagttctcaggttttagtactgaaagtcccacatcctgaaaagctacaagttctaggcaaatttgaaatgcttttcctgggactgtcttggttttaaaattgcaagtcccatgtcccaggaacaccctctgtccttaccaaaccagatgggtggtcacccaagtttcaactgtgtaattactccagaattagatcctgaggtagatccaggtttattttggagatgcaaaacgctttaatatgatacagtgaagataagacagccaatcaataaaagaaacattattaagccagatatcccagtgagcaaccagagcttaatcccatgggaaactccaggaaatagggcaaaacacatgcttcagaaatttcccagtagagaagcaagggtgtgggagatttacatgccaatttctgagagtcattggcaaagggctactcctagagggttttaaattccaggcactttcagcctgctggccacgaatagtatggtttgattgtagttccaagaaaaaaagcaaattctggcttaagtatgcagacattggcagcaggaatttggtgggagactctgaggggtctggatgagacgagtagggaaaattagcatttgttactgctcaccccttgcaatacccagatccatttgtgacccctgttaagttgacatcatcatagtaagggagtggctgactggtcacgacttattacaggagtttttatgggaaaagctacaattctgcccatcatctctcttctctaacacacgttttaggttcctctgcccttggccagcaatttgatttccccagtgagggcagagcatcctctcctgaacctgaatcaatgtatatttcaccctcttgaattgggagctaggaatagaaactcatagtttgtagatttggcagtgtgataattcaaatgctgtctaatggtccatagttagagatatttcagttatctatgttatggggccgaatctcatcacttgaaacagaactcctgtattcacccaaggccagctcgttctcatcagtgttgaaaagaggtgatcctgtgtattttcttcatccctctattgcacatcacattaatcattttactgcattaatgagacaatatcaattccaatgcttcatttaaatatggaacttcatctcaggaaatgtgctaaggtggaagcaatctgcttcctttccctttttatacattagaaacaatttttaattgtaattttataacttggtcattgcagtgtgtgatatgcaaaataagggctctccctaaagatgtgcgtatcccaatccacagaacctgtgaatgggttaccttacacagcaaaagggactttgcaggtgtttttaaattaaggatcttggtatgggaagattatcctggactacctgagtggattcaatgtaattacaagaattcttgtaagtgaaagatacagcctccagtgagagtcagagaaggaaatgtgacgacagaagcagtgggtggagtggcacaatggttggtttgaagacagaggaagtggtcatgaaccaagtgatgtgggtggcttctagaagctagagaaggcaaacaatggattctcccctagaaccttcagaaggagtgcagccctgctgacaccttaatttaagacacctgaaatgcatttcagacttctgatctcactgcaaggtaatacatttttgtattttaaaccactaagttcatggtagtttgctactgcagcaataagaaactaatcacaggtgtaaaggatgacaatcatctttgcagctgaagtggaagcagtgatgtctctacttctgctggaactatagtatagatgctaataatctagttagtgaaatcaagttcacagctctatcacttactcgctatgtggccttgagaaagttatgcaacaactttaaggcttggtttcctcatctgtaagatgggggaaataaggatttgtatcttatattgttgttataagcattgagcaagataatttagaaaatgcatttaagagagttcccagtacataataacagctcaaaaacattgactattattgcaacataacaataatgatctttattttgtgatgatctcagtttataaggtgttctcacatatgggtgtttaagcttgaatcaattctgtaagatcattttccccttctctcccttaccatttcccagatagacacatagagtcctggggaggataatgaatgttcacaagatctctgagttattaatagacatagctgagattgacttctcagttcttcactgctgagtcaattttgaaaatataataagtttctaaattccagaggtaaagaaaaaaatgttcttaaaacgatacacaaagccacacacatttagtaatgtctctcagaaaacaactggctgctgcttgttgaacagagttgtatactgatacctgttttcagacgtgtaaaagctatagttttattatttttaaatgaatagtccatagaaaaaggcttgtataacgttttctatggctgctgtatctttgggttcagtccataactatttacaaagatgagctctggtggcaaggcaaaaaagggttgtaaattgggaggtttcaggatcagaagccacccagtgattgctgaagatgagaccaaattgtggagatatttgctattatatataaaattcccacatgataatgagtaataagttattttttctatcactttcatggtataaatgatatcaaagcacttctttactgcctcttcaaactttctccaggagctgagaagacatattggagaaaatttgtgtgaacagcctggagaagaagaccatacaattggaggactatgacttatatgtcatttataataatagtagcaatagcaaatgctcgttgggtgcatggaaagtgccaggcacagcactaatcacacactaatcacacacacgcatgcacacacacacacacaccagaaatgttatatatatatgaaacatttgttccttataacaaccctggaaagtagattctattatttgaatgcgtagatgaggaaactgagacagaaaggctaagtaacctcctcaaggtcacagagttagtaaatggcagagatgggaattgagctcagggagccaggctgcacagcctatattctacctactaataagctaccctggaaggaacagtacccatctctgagagagcagaacacaggacaggtgggttttgagagcaagagggggaatgctgggtagagagtgcagatgcaggtaagggaccacagcagtatcttgacctctacagtaagaaaggggcactcagtgtgtgtctgcacaatgacagaggggcctgggatatagggagccaataatgaatagtctttatctagtccacagtttagccaagggccagccctagctaaatgaattaaagaatcagagaaaataagatcttttgtaaaagtgtgcttgtttgatttactgactcatttgggaattattaacccaagtgccagggtggaatgagcataattgtttttacttagaagagcacctaagcctaaattgctgggtgcaaataaatctattcctgggaggcagctggggagcccccgcaggcttgttcctggcctcctcctctgggggctagaggagccagctaagcacacggcattctttaggctgaagtgagaatttactcctgaatgctaaaggggcttgctccatgtataatcaaggcttactgaaggaaaaaaaaaacacacacacacgcacaaaaaactgggaaggaaaatttatttttgatgcctccatatttttctctgacttatgtgcctcatcacctcaaaagtccaccattgcaactgtgtgtgtgtgtgtgtgtttgtgtgtgtgtgtgtgtgtctttcagaatctcctttttccctctggggatgtcaacttcctaaattgccagtgccctcacaatttttcacaatccctgtcttcctcagccttctcctgtggcaccacctccacacagcagcttcaattacatggtttccatgggtagaaacaagcaaaggcagacactggccataaaactgactgatgcaacttcaagttagcctggggcagatatttttaaagaacattgttttaggccataacactttaccttgacggagtgaaactaggccggtagaatttcaggcagagaagcggacaggtgtgtggactattctagaccagcaaatgagatggtgggtccttctccagaaatccttgcatcatgtttttacagtaagcttcttgtttgcttatgcataacattactctggcccctgtgaatgtggagaaactggcctccatgtctcttgggtcagtctctgttgagctgtgggtctttgtcatggatgtcacgtacatataccttagagaaaagataaaagagttggaggggtgggcttgagaaaggctgtataattttattgagcaatatttcttctttaaatgggctcatggataattcaattagctggcttttgattgctcttgttagtggttaggcgctatataatgaaaatatggatttgttcaagtctcaccatcacaaaccagcttgtcaggatggatgattcaacagatccacagtgggtgtgacataggttcaagtgtgtactgaccatattcctctttagcgtgtgtgtactctctttcttgctggctctctctggatctctttctcagctttgtttggagatggagctaacagttgtagaaaataaatatctgcctaaaccgagtggacagcagccaatgagaatactgtgaaacttccccgtggaaagctccatgacatggcatatgcgagtctgtctctctcattgatgctatatgcagacggtatatatcagctagaagactttgaaaaggagatttattaagtgtcaggttgagagttgtgttttcatcttgattatgaaaatgatatataattttaaaaacaattatggtgcttgataaatttctctgtttgtataaacttcccatttcaggaattctacatgtaattcagtctgtgtgtcctgagagaagtcctgagaaaggagaccgagtgcattcagcatgctagaatgatttctccatgagaacaggttaaaaggcatagtgggaatcagtgcagggatacaaggtctgagtaggaatggcatatacatcctcagaattaaagagggtacaggcaggatgaaaatacacttgtttatcacatcactgaaagctgggaagggggatttgcttgaagcttgaaagcagtgatttaagaccagaatcacaggtgcattttgcataggtcataagcactattgatcatgtgcagtgtcttgaaagggaagtagattccaaaaaagagcagatatgtacatgaagaataaaactgtagttgacgattaaaggtacattatgaacactcaagaaatgtctctatttttgaggatgaggtcatctttctccacaaaacacccttcaggaaaggagggggaggttgaaccactggtgcagcatggtttctctctttttgtgtgccctgaatatatcacatttatccctcatcaaagagaaatttttctttttattgggaaatgtagaagtgatacctcaaacgatatggtttttgtttccaaagacatggtagggggttcaatgcttccaaaaaacatatactagacataagtatgtggtattttattttagatgctatcagttgatcttttgctactacatttctaacagccaaaacctcttagtgactatcacttatttttttctttaataatcttatttttgtgtagactaagtagtctcaaaccaagctatttctggggttgggaggaggtaggtaatatagactatcaaggtgaatcaagggcaccgcaacaggggatggtgaggactgcaggaaactgaagctcctatgcttttgttaagggagacttctgctactcagtttcaaccagtagttgccatatggggcttcaggcccaatattgtgatcctaggcaaatctttcaaagagatgccacaaacatggtcaaataagcaaagtttttttgtcatttaaaataatgcgcaggtcctgaaagactagttcatgacttctggagaataatttattcttgggaaagtgaacaccaaacaaataaacagcaagaacaaagcatgaatgaaacaaaaagcaggttcttgaccaaaccaatgaaaataaaatcaacaaggaattgtgacttcctatacatatgcatgaccctagggtttttccaatggaaaagtctaaaccataagctgaaattcctattctctgctagctgcacatcaagagtggagacaaatatttcagtttgaagtagtaggggaggattcatagaagaggtaatatttgaattatgagttgaaatttggatgtggcttggttaagagataaccataacgaagaagcagtcctcatgggttgaatgaagggaagaaatgctccatggtggggaaagttaccaattccttttctggggaaatagtgacaccaaaagctctcaaaagcaattagctaaaagcactagtttttgacagtcttcagtggcagtcttaagtctgaactttatcgtctaacaggtggttgccaactcaaatgcccacaggggccagacaggtaacctaaaaagaaaaatgattttggagaatgggacactgtatccagattaaaaaaacaggctcagctccagtggatccttgccacgtagaaatgcagcaccagcattgcctaagagaagttcgaaatctgggtttttatttgcaagttagaattttaaaatgttggcagcaaattcacattaaaaaggaaaagtgtgaatcaaagcttatttgaaatcccatatgtaaaataaactcagggctgcgggtgatgagggctgggattacccaggccccagtcactgagctacatactttcccttcttgagctaacggtgggtctcatcttagagaacgttttaaatactactgctactggtaataagaaaccattaaagatgcaataaatttggcatgcaccataattatacatatgttttagaaaaaagtttgcgcatggacaagaagtataaaatgaaaatagtttttgaaagtaaaaatatttttaaaaggttacatttcataattataatgtaaaatttaagttagggaaacattgattaaaaatatctttctagagtcttgtgactttgccaccaatagaaatctcaggtatttttatactgttgaaatgcagatggcttgaaaaatcacttagggttcttactacaggtattttgaaattacagtcattattcagacctgcagacctgcagtcagattatgttctttaatgcattaataaagaagcatacatcttattatatcacacatttttaaaatgttatttcattataattagttttctttttaatcctttattttaaaagggatgcataggcttcactggaccactaaaggagtccatggcacaaggaaagttaggaaggctgttcggaaccagtgtagcagtaaataaaaagattacccactctggcgatgccagaattgcttttctttccaaagatttcctacccccaggtaggactttttacctttccaatgtgagtttcctgtggcttacaggaattcagctggaatcctacattactctgcaacagaataaaaaacaaaacttaataagttgacaacttaaagaaaaataaattcaaatatgtaaaagcaaaataggggagaaccggcagaatgctgctgtgtagcaaacccaggtggagaggtaaaaacgtgatgaggtgggaaaggaagacggccaacgtggatcacgtgaaaaaccagctgggaggacattttctccgaaaaaagaaatggggatagttgatgaggagtcaggaggactctctgggctcttttaggaaaaatatcttctgaagcatattttttttattacctgaacagtgatgaaaggacaaagtttcagtttcctagggaaatgcactggctgtgaccaaattagtccagaatttgctattatttaaatgcagtttcttgtatttattaaaatgaagtgactgtcatattaaaattgaaaacgagcagttgcacatgcaaattatttctaaagttcaactgctgctaaatgagacgcggtgctcttaaacttagaaatgcttaacataaattatgacctaattaacatttgcacggtaatccggacttcctacagctttttctgctaattaacacatgacaaatgagcatacattaatattttattgtaacatcacttgtccaagaaagcttcttaactcctcagaaaatattttgtgttttgtgtaattttttttgccattttctgcttgagaagtatcctattgtggtttatgccattgtataatattaatgataaagttgtcttgtgttgtaaatttaataagatcagcaaagatgcaagctctaggaatcttttatcttcatttaaactcttttctttattctttctagggaatatcagcatttttgagaaaaaaataaactaattgccttgatatgtacatcttagctaattatcactttccatggttggttgcctcctagagctatgggttcatgagtaaaggtagacccatcaagaagagcaaaatcatgtataaggctatagattttaagctttgtaagtggtttaattttgactgtatattcagtttgtgtcatctgttatctaaattgtaacagccctcaaattagggagatcagaacacttctacatctacaacagacagagagcgactaactatgaatgtctactgtaactttaatttttattggggcacagcttctcagttttgatttgctctcctggtatattgcaggggtttttgtttgttttaatttgttttacttgggattttccaaggatgactgcagaatacatttttatctgatcacataaatcagagtctgtgatctttgaggtctgggagattttctcaactagaaagagagcatcttgctgtgacgggcaatgtattgggtgttttgcaagcacattacaagggcacgtaatgaacgactgatagggtcccagtgtcttcccctttatgtttaaagaaacccttgaggttattgagcactttcctgatgaatgcttgaatcctattcacagccttccaaacctatttctatcaatgccttttgacttagaactcacaagggagccagtgaaagtgctggagagtacaaattgtgagtggagacatagatgaatttgtatatgtgtgtatatatacataggtagatatagagacgacatatacatatgtgtgtatacatagatgtttgtgtgtatgtgtgtgtgtgtatatatatatatatatatatatatacacacacattacctatgcctctgtctattgatcaatctatctatctctttatttttattagctaaaaattgaaaacaacccaaatgttcattgacaggtagatagagaaataaattgtgatatatccatacaataggatgctcagcaataaaaactaatgaactattgaaatgtgcaacaacatggataaatgtcaaaatcattatgccagacaaaaatgtgtacatactgtatggtttcacttacataaatgtgtagaaaatacaaacaatagtgataggaagcagatcagtagttacttgggagggggttggatagagattataaagcagcaggcagaaattctcttgattgtagtgatggtttcacaggtgaatgcatatatcaaaatttatcaaatcatacatgaaatatttacattttattatatatcaataaagccgtatgtgtcatatatgtatgtacacatttctgtgttggtgagtgtattgtttgtttactcttttttttgccaacaaagtattagttccatgagagcagataagtttatctttggtccagtgctatattccagcttctagaatgtgcttggcacatagtaggagcttgataaatatttgggaaataaataaatgcaaagaaggcatatacacctctctgtagatatatgtaagcactatgcttctgcttttaaatgtgtgtctgtctaaagaacatcaccatctttttctctatctgaatggtgcaggaatggtatatatctcagacagttctggaaaatataaaataatttcaggttgcaaagaactgagcagtacccaggttatacagaataaccaggtagaaggagaattcaactgtaggttgagatacagtagattagccaaatatttcatgagaggagctgaccatgaagacataatttctgattttcacaagagaaaaccttcaggtgattctgggaattatggtaagattataaaaggcatcaagaggcaacaaaaagctgaggcaggataacctgggactaagatctgctgaattcaggacagagaggaagatatacaaaatagctgggaagaacgtgaggagggaactctggggtttttataagctgatgcctctatttctctgtcagggtgggagagtgacagatttccataaggcacaggggtttttaggggcaattaaataaaaatagtcaatgctgtaaagtctttgacatggtatcaagcaagacggccagctccatgtagaataactcataaactttctcattggatttgattttgggtgactggcgtagagccaggcagtaggctctaactgtgtccataatattggccaggattcaagttggagttctacaatgagattagttttcctcaaattaaccccaaatctacttccttgtgacatctacattttggtccttgttttgaattccatggctatcctaaatatgcctaacgtaaggatttgcctctttaattgtcccagagcatttttatgatcttcttaatcttctccaggttaaacactcccattccttcatcattttttcattaaatatattcatagtttctcacaagcttttctgttattcactccatcatttattacttccccaatgaccacaataaactgactttctattaaaagtttaatgtcctttttcctccaggagtggaggctccatgagagtgaggaatgtggttattgtgtttatttagtacatggcttgagaggtaatacaagcacttagttttaggaactagcatgctcctgcacatggtaggcatttactatttatttgtagagggagtggttttacaggattatttttactgtgttgttattgcaagttttgaatttgcatccattttaactgtaaattgctaagcattatgaccatccggtagccaacttttcttccttccttccttccattcttcctttttcctttcctttccttccatccttccttcctttcttccctctttccttcaattcaacaaacatttactgattgcctattctttgctcaatctaatgacacgatgttgaatgagactctgtccctactgtccaggagtagtagaaagacagattcataaacaattataataaggaaaaatacttactctaatgaaggaactaggaaatgctttacaaaaaaacaaaaaacaaaaaacaaaaacaagacaaaaaaaaagttactgtcggcctccataacactccttgttgcttcctttgacattcgccatccttgcagttcttcacatggcagtaatgtcttcagcaactcaagaaaataagtcatagcagatcacctggctttgggcattgttgactagagattaggaattaatacatgctaagcaagcacttttaacttaaaaaaagtttcaaactgaccattagatgaaagataagttaaataactggtttcaataagtgatacatataaaataagacatacagaaagaacaagatttcgaagctatgggatattatattcaagttgtcattttgtctatcaaggactttaatgcattcctcatggggttaactttactgtagatcttcttttccagaataagatacttatttctagctcagacggatttctcttgtttatattagctggctatttctgcttttctgaggcttgagacttcatagtataacagtgctgatggctttaagcttttaaatctttaatcaccctaattcctgtacttggggtcatattacttaagtaggcgccactattctcaggaatagaactgctaaaataaaaatatatctgtattttttcttcccctgtggtttacctaagacaaacccgagagaacatggaactggaaagcacaaacttcttatttccttcaaaattattctttgcctgatcacaaaagacctcatgtgttatggttctagtagcgtggtttgtcatctctcttccactttttttcttagtaaatagaaaattcattagatcttgtttagtcttgttcctttgtatcagacagtaataaggatggccataaaaacaacaggggctaacattttggagcacgtattatgtgagaatttgcggactaagtcccatacatgcattatctgatttaatccccatattattgtatgtgcatagactctaatacaaaggttgtcagtaacacagtttcctgtgctctgccctttgagagtttaattcaagagatctagaggaggtgcagagctatgcatttttggatggttttaagaaaaggagtagctgcagtttttaatacatatgctggaacattgtaatgaaggtgttgctaagactggactttggaaaataatggtttgtatgcaccataatagataaatctctgagatggtgtattagtccattttcacactgctgataaagacatacccgagactgggtaatttatacagcagaaagggtttaaggaacttagagttccatgtggctggggaggccttacaatcatggcagaagccaaggaggaacaagtcacattttatgtggatggtggcaggcaaagagagagcttgagcagggaaagtcccccttatagaaccatcagatttcgtgagacttatttactatcatgagaacagcatgggaaagacctgctcccatgattcaaccacctcccactgggtccctcccacaacacatgggacttgtgggagatacagttcaagaggacatttgggtggggacacagccaaaccgtatcattccacccctcacccctcccaaacttcatcctcacatttcaaaaccagccatgccttccctcacagtcttaacttatttcggcattaactcaaaagttcacagtccaaagtctcatctgagacaaggcaagtcccttctgcctatgagcctgtaaaatcaaaagcaagttagttacttcctagatacaatgaggttgtaggcattgggtaaatacagccattctaaatggtagtaattggccaaaacataggggctacaggccccatgtaagtccaaaatacagcagggcagtcaaatcttaaagctccaaaatgatctcctttgaatccatgtctcacatcgaggtcacactgatgcaagaggtgggttcccatggtcttgggcagctccacctctgtgcctttgcagggtatggtctccctcctggcttctttcacgggctggcattgagtgtctatggcttttccaggcgcatggtgcaaggtgtcagtggctctaccattctggggactgggggatgattgccatcttctcacagattcactaagcagtgccccagcagagactctgtgtgggggctctaatcctacatttccttccacactgcattagcagaggttttccatgagggtcccacccttacagcaaacttctgcctgaacatccaggcatttctatacatcttctgaaatctagatgaggttcccaaacctcagttcttgatgtctgtgcaactgcaggctcaacatcacatggaagctgctaagacttgggacttgcaccctctgaagccacagcccgagctataccttggcccattttagctgcagttggaacagctgggttgcagggcaccaaatccctaggctgcacacagcagggggccccttggccaagcctaggaaaccatcttgtccacctaggccagtgatgggaggggctgtgatgggacgggctgccatgaagacctctgacatgccctggagacatttcccccattgtcttggggattaacatttggctcctagttacttatgtaaatttctgcagccagcttgaatttctcctcagagaatgagattttcttttctattgcattgtcaggctacacattttctgaacttttatgctctgtttcccttataaaactgaatgcctttaacagcacccaagtcacctcttgaatgttttgctgcttagaaatttcttcctccagataacctaaatcatctctctcaagttcaaagttccacaaatctctagggcatgggcaaaatgccaccagtctctttgctaaaatgtaccaagtatcaccttctccagttccccacaagttcttcatttccatctgataacaccttggtcaggatttcattgtccatatcattatcagcattttgttcaaagccattcaacaagtctctagggagttccaaacttccccacattttcttgtcttcttctgacccctctgaactgttccaacctctgtttgttacctagttccaaattcacttccacattttcaggtatcttttcagcagtcccccattctcctggtcccaatttactgtattagtccatttttacactgctgagacatgtccgagactgagtaatttatacaggaaaaagggtttaatgaacttacagttccatgtggctgaggaggcctctcaatcatggcagaagccaaggaggaggaagtcacaccttatgtggatggcagcaggcaaagagagagcttgtgcagggaaacgcccccttacagatgagatctcgtgagactttttcactatcatgagaacagtctgggaaagacctgcccccgtgattcaacaacctcccaccaggtccctcccaaacatgagaattgtgggagagacaattcaagatgagatttgggtggggacacagccaaactatatcagatggaaatcacatcatcagtggggtgaatggggtgatggagggaaatcagggaaggctcactggaagaggtgtggtataggaatttgaaacagaactctggagccagggagctccagctctcgtgccagctctgccacttgctagttgtgccacttagcatttctgtgcctcagttccccctctgtattaggctgttcttgcatggctaccaagaaacaccagaggctggataatttttaacgaaaaaagatttaattggctcatggttctgcagactttacaggaatcatggtgatggcaactgctcggcttctggggaggcctcaggaaggttttattaatggcagaaggcaaagcgaggaagaggcacatcatatggtgaaatgaccagatcttaggagaactcactcgctatcacaaagatagcaccaagccatgagggatccgcccccatgtcccaaacacctcccaccagaccccacctccagtattaggaattacaattagacataaaatttgggtaaggacaaatatctaaactatatcaccatctataaaatgagaatagcaatagtattttatgcatatagtcactgaaataattaaatagaccaatgcctgtaatttgcttagaacacttccaggaacattgttaagagtggtttaatattttctctctttatatttttgtggttggaggatgtaatccttgaactgaggcttacagggtgaggaagagtcaacctagtgaaggaccagatgtggcaatggcaggtggcctctgcggcagagcagatatcatgagcaacagcacagatatgagaagcagcctcgtgtggcttgagtgtgaagtacgggaagtgaggttagagaagtaggtagaggtcaggttgtgaaggtccttgagttttatactgtgaattttaaagtgatggagaaccattcccaggagttacagagggtggtgttttagttgtttccagggtagaaatgtggaaaatggatttgggaaaaataagaccagagacagggtgacaagttaagcagacctgcaggagtccaggtgacagatggggaagagatagaacaaggatagaaaggatagccaagaaacatttaggagataaaataggcacgtcctgattttaaagggagaggttaggaagaagagagggacgacgagccaggtttctgttttggaattaggtgaatggtgacaccacagagataaagcagaatggagtttttacagatttagtgagttcagttttgggctgtggagtttgtgacacctgtggggtgtccccagagggatgcctactggcagttggacattatggatgtgaagtttagtgactggttttgtctgaagcttgaaacacgtgatctagtagaaacaaaagctctgggtaaactgaaaagaacactacaaacataaagcattcagatcagtgttattcggttcttgtagtcttcagcattaattagtttgttagaatacaaagaactccaatgaaatttacctaaaaaggaagaatgtactcttcccctggctcattagaaggatttctgaagagaaaattctgtgtgcaatgacatgcatttaaattccaggcttccaaagaaaatttcaagacaggctatccttattcttggttaattagaacataagtagataaaccagcagaagagacctcctttgagtaggctttgctgtttttttgggtttcttggaggattacttatacctagggctttgttatacgaagatatttttatagatttactgaacgttagagttagaggcaacctgatcttacatgttagaaagaagaaatccctcaaggttgaatgatttactccaggtttcatcttcaacacatggcagagccaggccctagcaaaggtccacaggactagagcaatgggcttcttcagtgttctatgctgattcttattctgcagcattaacaaatatgtcccccacctcctaactctttctttttcctctttatcttgctaaagggaacataaacataagaataaatatagcactatgagggtggccatgttgtctgggaaaactttcctcaccaggacatagcctattactctcaaactgtctaataaggtttagttggaaaattctgttgggattaaactgtttccatatttaaaagataagtattgcatctctatacacaatatttttttttctccaatgtatattagttatactggtggtgagagtagcacagcagttgtagtagcagcagccacagcagtggtaggagtagctacagtagaaaggcaggggtggaggtagtaatgatgatggtgatggtgatgatgatatgtatttagtgagtgcttagagcagtggtctccaacctttttggcaccaggaacaggttttgtggaagacaatttttccaagacctggggtaggtgggggatatggttttgggatgattcaagcacattacatttattgtgcactttatgtctattattattacattataatgtataatgaataattattaactcaccataatgtggaatcagtgggaggcctgagcttgctttcctgcaactagacagtcccatctgcgggtgatgggagacagtgacagatcatcaggcattagattctcatacggattgcacaatctagatctcacacctatgcagttcacaatagagttcttgctcctatgagaatttaacaccaccactgatctgacaggaggtggagctcagggcttaatgcgagtgacagggagctgctgtaaatacagatgaaaattcacttgctcacctgctgcttacctccctcctactgtgtggtccagttcctgataggctgtggactggtactggtccgtggtctggggattgggaacccctgccttagaggctgtatagaagcttaacggaagactctgatgctcaagttcaaattcctgaggttgtatcccagtgtaactatttcctgctctatgaccttgggcaaatattaaacttcttgaagtctcaatttcctcatcaataaaaagaaggaaaacaaaaatgcctacagcaaagggatatgatgacactaaaatgaaaaagaaaaaagtatataaggcttctgacaaaacttgtaaccctgactgtgagagagatttgattatttacctccattttacatattaggaaacagagactcagggagatgaaataatctacaagtctattttatggcagagctgaaattcatatcaggtctatctgactcttgagcttgtctcataaccaccatatacattttctttggataaattgcttcaattttgaatcctgaaaattacttcttgagtcttgaaaaacaagctatttaggtcatttttgtgtttgccattccaggatagttgtcaacatacagaatgttgcatttctgaattctctgaaattgttgcaacaagatgtttctgttgtaaagagtagtcctttggatcatggatgattaaccttccccatgaacctggcaggtgacaaaagtgtacctttggttttcaagactgaggaccagacaaagtagaatcacagaagacagagccagggccaatagacactgttagtggaaaagtgtctgaaactataacttttgcctatttcttttgtatacaatattgcactgagactggccagaggtggtgcctactttgtacaggtggcatagtgattgcctgaccttctgtatagatatactattggcaccaggggtaaaataagctgccttttgcctttccattgaagcctgtgacctctgagattctgactcttactcctaggctaatagactatttgtgaccttcaatgagtttccttcccctttgttccttttctataagctgattcagaaaccaacttgtagtttgtgataagagtattgaaaacctaactatgatattacattcaaccccacaaagaaattttacttcagtggaattataatgaattgctttcattttacaccattttaaaccccaatgactttaacaagagggctgttgaaagtaaatgccaccttattacatactgtgaagaagcagcaattaagatgttgtctaagttagtcaactttctaacttagaatttcccaagtgtctcaagtgggtagaaaaatgaagccaatgtcaaatgtcaacactactggtgatggaccaagaacgactatcttttcttctttccctttttttttttttttttggacaaggttttgctctgtcacccaggctagagtacagtggtacaatcttggctcactgcagctttgaccttccaggctcaggccatcctccttcctcagcctccctactggctgggactacaggcacatgccaccatgcctagctaagttttgcatttttcgcagagatggggtttcaccatgtttcccaggctggtcttgaactcctgggctcaagcaatcctgctgcctcagtctctcaaagtgctgggattacaggcattagcctctgtgcctggctgatccactatctttcataggaaaaagaaatccatcccaatcatctaggaaaaatctccatcagcagaatcaagtgagcatcacagaaatgtggtttttgttgggttgttccactgttatttaagcattcttggtgaaagttgaatggaaaggcaaagacctgaacccagtgtttttacttgtggtgtagtggtctttgaagatgagagtctgataaaagagaattctaaagtagcccacacagaagtcaacaagccataaggggtttttccattgttcctacttctttttttttttgaatgtttgtttgtttgtttgttttaaattatactttaagttttagggtacatgtgcacattgtgcaggttagttacatatgtatacatgtgccatgctggtgcgctgcacccactaactcatcatctagcattaggtatatctcccaatgctatccctcccccctccccccaccccccaccagtccccagagtgtgatattccccttcctgtgtccatgcgatctcatcgttcaattcccacctacgagtgagaatatgcggtgtttggttttttgttcttgtgatagtttactgagaatgatgctttccaatttcatccatgtccctacaaaggacatgaactcatcattttttatggctgtatagtattccatggtgtatatgtgccacattatcttaatccagtctatcattgttggacatttgggttggttccaagtctttgctattgtgaataatgccgcaataaacatacatgttcatgtgtctttatagcagcatgatttatagtcctttgggtatatacccagtaatgggatggctgggtcaaatggtatttccagttctagatccccgaggaatcgccacactgacttccacaatggttgaactagtttacaatcccaccaacagtgtaaaagtgttcctatttctccacatcctctccagcacctgttgtttcctgactttttaatgattgccattctcactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctcgatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgtggcgttatttctgagggctctgttctgttccattgatctatatctctattttggtaccagtaccatgctgttttggttactgtagcctagtagtatagtttgaagtcaggtagtgtgatgcctccagctttgttcttttggcttaggatagacttggcgatgcgggctcttttttggttccatatgaactttaaagtagtttttttccaattctgtgaagaaaggcattggtagcttgatggggatggcattgaatctgtaaattaccttgggcagtatggacactttcacgatattgattcttcctacccatgagcatggaatcttcttccatttgtttgtatcctcttttatttcattgagcagtggtttgtagttctccttgaagaggtccttcacatcccttgtaagctggattcctaggtattttattctctttgaagcaattgtgaatgggagttcactcatgatttggctctctgtttgtctgttgttggtgtataagaatgcttgtgatttttgtacattgattttgtatcctgagactctgctgaagttccttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagaggtcatccctgtcttgtgccagttttcaaagggaatgcttccaatttttgcccattcagtatgatattggctgtgggtttgtcatagatagctcttattatcttgagatacgtcccatcaatacctaatttattgagagtttttagcatgaagggttgttgaattttgtcagaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggacattggtctaaaattctctttttttgttgtgtctctgcctggctttggtatcagaatgatgctgtcctcataaaatgagttagggaggattccctctttttctattgattggaatagtttcagaaggaatggtagcagctcctccttgtacctctggtagaattcggctgtgaatccatctggtcctgtactctttttggctggtaagctattgattgttgccacaatttcagagcctgttattggtctattcagagattcaacttcttcctggtttagtcttggtagagggtatgtgtccaggaatttatccacttcttctagattttctagtttatctgcatagaggtgtttgtagtattctctgatggtagtttgtatttctgtgggattggtggtgatatcccctttatcattttttattgccgtctatttgattcttctctctttttctcattaatagtcttgctagtagtctatcaatttagttgatcctttcaaaaaaccagctcctggattcattgattttttgaagggttttttgtgtctctatttccttcagttctgctctgattttagttagttcttgccttctgctagcttttgaatgtgttttctcttgcttttctagttcttttaattgtgatgttagggtgtcaattttggatctttcctgctttctcttatgggcatttaatgctataaatttccctctacacactgctttgaatgcgtcccagagattctggtatgttgtgtctttgttctcgttggtttcaaagaacatctttatttctgccttcatttcgttatgtacctagtagtcattcaggagcaggttgttcagtttccatgtagttgagcggttttgagtgagattcttaatcctgagttctagtttgattgcactgtggtctgagagacagtttgttataacttgtgttcttttacatttgctgaggagagctttacttccaagtatgtggtcaattttggaataggtgtggtgtggtgctgaaaaaaatgtatattctgttgatttggggtggagagctctgtagatgtctattaggtcggcttggtgcagagctgagttcaattcctgggtatccttgttgactttctgtcccgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttaccagagactaggattgcaacccctgcctttttttattttccatttgcttggtagatcttcctccatccttttattttgagcctatgtgtgtctctgcacgtgagatggatttcctgaatacagcagactgatgggtcttgactcttgatccaattttccagtctgtgtcttttaattggagcatttagtccatttacatttcaagttaatattgttatgtgtgaatttgatcctgtcattatgaggttagctggttattttgctcgttagttgatgcagtttcttcctagtctcgatggtctttacattttggcatgattttgcaatggctggtaccggttgttcctgtccatgtttagcgcttccttcaggagctcttttagggcaggcctggtggtgacaaaatctctcagcatttgcttgtctgtaaagtattttatttctcctttgcttatgaagcatagtttggctggatatgaaattctgggttgaaaattcttttctttaagaatgttgaatattggcccccactctcttctggcttgtagggtttctgccgagagatctgctgttagtctgatggcttccctttgagggtaacctgacctttctctctggctgcccttaacattttttccttcatttcaactttggtgaatctgacaattatgtgtcttggagttggtcttctcgaggagtacctttgtggtgttctctatatttcctgaatctgaacgttggcctaccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctggggcttctgcattcttcacgtagttctcgagccttggttttcatctccatcagctcctttaagcacttctttgtattggttattgtagttatacattcttctaaatttttttcgaagttttcaacttctttgcctttggtttgaatgtcctcccatagctcagagtaatttgatcgtctgaagccttcttctctcagctcgtcaaagtcattctccatccagctttgttccgttgctggtgaggacctgcgttcctttggaggaggagaggcgctctgctttttagagtttccagtttttctgttctgtttgttccccatctttgtggttttatctagttttggtctttgatgatggtgatgtacagatgggtttttggtgtggatgtcctttctgtttgttagttttccttctaacagacaggaccctcagctgcaggtctgttggaataccctgccgtgtaaggtgtcaatgtgcccctgctgaggggtgcctcccagttaggctgctcgggggtcaggggtcagggacccatttgaggaggcagtctgccccttctcagatctccagctgcgtgctgggagaaccactgctctcgtcaaagctgtcagacagggacatttaagtctgcagaggttactgctgtctttttgtttgtctttgccctgcccctagaggtggagcctacagaggcaggcaggcctccttgagctgtggtgggctccacccagttcgagcttcctggctgctttgtttacctaatcaagcctgggcaatggcgggcgcccctctcccagcctcgctgccaccttgtagtttgatctcagactgctgtgctagcaatcagtgagactccatgggcgtaggaccctctgagccaggtgcaggatataatctcgtggtgcgctgttttttaagcccattggaaaagcgcagtactcgggtgggagtgacccaattttccagttgccgtccgtcacccctttctttgacttggaaagggaactccctgaccccttgcgcttcccaagtgaggcagtgcctcaccctgcttcggctcgcgcatggtgtgcgcacccactgagctgcgcccactgtctggcactccctagtgagatgaacccggtacctcagatggaaatgcagaaatcaccatcttgtgcgtcgctcacgctgggagctgtagaccggagctgttcctattcggccatcttggctcctcccccctgttcctacttcctaattaatttattcctcatttttttcctgaagcaatttatagaaaccttaaatataagaggcacatcaacatagggttataagtctgaattttgctgtctgatagacatgaggtcaggtcctaaaatataacattttctagctttgtgacatcaaacaaattattaatctctcaaagtcttgtttccacaactgtaaaatggacaaatgcatagtacttaaattattttggttgtttgagcactgaaagagtttaagttagtaccaaagcaattgctatgctgttgctgttgatcatgatgataacgatgatgatgatgagtttagttttatattgtattataatactttgtttatgtctgcctgtcacactatatagtgagggccttgaagggaggaatgaattgtatttatgttgtgtctttcagagactgacacagtttcagctactttggaggcatctaaaaatgtaagactaaatggaaggaagtggagcttcggagctatcgagtcctggttgtcattactaattatgctatttgacattgagaaagtcattgccttcttggtttatccacttctccatatacaaggaggaagtattctacctaccctttagggatgctataagaatgcatttaacatttaattgcaaattgtaccttaatttgtgaaggattaatattaaatattaatgaagatcacagccttccatttcactcctttctttgtagttgcagagtactcaccagcataatggagcccgaaaggaaaaatgtgaaggctaggtcttatgtcatgcacatatcaaatgagagagagcttctaaaatcagagaagggctctatccagaaacaaaatacattctgggcagtaaggaaattaattgaggctatcatctgcaccaaaccttcagccccaacctattaacttctaagtagttaaatattttaggtgataatcacttttgcctttgtttgaattatctgaattttaattgcctgttttctatagattttatgtgaaaaacatttcaagtaaaataatacattaaaaggacgagggaagaactccacaaagtgatcattatgtgtgaacactgagattatagatgatttctttgttcttccttattccaaacttggtttaatttagctcatttagtggcatggaacagagtcattcagaccagcacaagtgcatggatgtttatggtcactaggcctatgggctctcttgacaacttgtgaacaggcattctgacactattgtggctcatgggaaatggagttaaatgggaagcatcactgcagatctgagcagtagaagatcttgtatgctctggcaattcccagcttcagctcctttcttggtcttgacttcttctggcatcttttcttgtttctggtctgttaccaactagctgacattcagccttgatattttttttttctctccctcagcttcggatttttcatgatcatgcttcttcataagtgcagtacattctccacatatcttgttagtgtccctcccgacctgtatattaccacaggaacctcttttttctttgcatgcattcaaattcagacatcactgcaaagactcttctttccatatttccctatttaaatgtcagagagtgaaaatcttaatggctcagctcattcctctgtaagcaatgctattcatgccagtataccacatgggctcctggctggctaattggctgggtaccctcagttctggaggtgaccaaacacgtgatgtgatgggtatactacatggcggtctagggccatccctaagtaaggactatgagctgggaaatttccctgatggaggaatataggtgtggcaggcacctctttagtggagttgttatgttatttttatatgtgtaaaatatatatttagcactggaaatagattattagaagaattttgttcacatccagcttagaaaagataagaatttctctttatgtatgtctttgttgtatcagtagctcttttctgccacgtttttgtgctgctgtgcctttcttatattataccttgtgcttggaagatcagtccaaaaaatttctctgccaggatgcttccaaaattcgggtttcacctctaactcttagtcttgtttcctttaaaaaattagtccccggctggacatggtggctcacgcctgtaatcgcagtagtttaggaggctgaggcgggtggatcacctgaggtcaggagtttgagaccagcctggctaacatggtgaaaccccatctctactaaaacatacaaaattagctgggcgcggtggcaggcggctgtgatcccagctacttgggaggctcaggcaggagaatcgcttgaagccgggaggcggaggttgcagcgagccgagatagcgccattgcactccagcctgggagacagagcaagactccgtctaaaaaaaaaaaaaaaaccaaaaaaaccaaataacaaaaagtagcccccatacttcagtgggaatcggctgccttctctcctatactctttactctttagttctttgtacttttgttgcagcactttgaaatatctgtccttatgttagagtcactgctgtatgtactttcctccccattgtaatgtgaactccaggtcataaaaattttatctcgttatccatgcatcagtagcacactataaacatgtgtgttcaaatgaaacactttggggttacaatatagaaatgataaaatggactcacaataggatttctcacctactgtgagtcagggattttctcacttaaccctttttataattcctgagagtaaggcattgctatctttattttatagatagtggataataagtctaaagtcagtaaccataaagggattctgtggttaaagaaatctggagacattcaattaaagaaagctaacagttttctctccaacaggacttatcaaggccttaattgtgaaacactcattagaaacccctaaacatacagagtatgcaacatttcctaacttatttgattatgattacatgttttgaggaataacttgcagggttagtgcacaaaggagcacattttgagcatgccaaggtgaataataatgcctgaattagagtgggcatttcagtgattctcctggaggttaaatgtcactgtaatatcaaacatgacagagtttcttggtacattgtcaaatatggctcttgatggttatcatcactcctgatcttcataagagactgaagatcaacctgctgccttccatagagctttgaagtggcttttatttgtttttgatttttatccactccaaagagtatatctgcgtattccaataatccaagttcctgtcacatatttagaaatcactggaactacctagccactcagagagtagggaaaggatattctttagctgagtgggttttcaatcaactccctcaaagtatactcccttagtattcttctgaagcatttccccaaatctctttccacagttcatgtagtgaatctgcaacacagtatccagccatgcctgaacaggtgtgcccaacatggaaggttctagccacaggtctggatctttattgcagaagatgaacactcagtaattttggtgttttagaaaatcaacatctgatgcttgatgagcccacgattctcccctctgccctgaaggaattgtctctgtttacatgaggtacagcccatttgtaaatattaatactaaaatgggcagttattaaccaagcatctggaagtggagaattacctgatgttctgatgtgagtagtggtctatgaggtaaaccacctaaggtcacttcctttcctttctcaaagtagactagggtcacagacacttccagcatattttccaagttattgagggcatttggtcattgagcttatccaggaaagtgtctaaccagggtcaggtgtcagtaactgtgtagaatacagggtatctttagggcttcttggagatgcaagtgaatatctgggcagtcctttacaatttgcagaagttctcttctttctctttgtcctctgatttcagcagcatgtgtattttgtatgtctcaattgtctgagttttggaagcatctctgattgttgcatgttaaaacagcattcttactttgcattttcacttattcttataaacttcttatagaactgtataaaaaacattttgactataatttttccttctaattttaaaatccatgtctgaattactgggatattttaaaagtatctttattctataatgagaatgaggggaaaggaagatgaaataccaaaacttacctttaatgtagtctaaatggtgatagcagcttttgccaataataatgattttgaaattgtcagacttgtggccacacatcctattgtgatataaacctattttcccagacagtggactagtagagaggcattctttatgctaacagataacaaaagactttaggtagtgttctcttaaatcatttacaaaaagaatctttccccttgatcaggaccattgaggttaacataggatgttagagcattattttccttgcaacatcgttttttcaaaatgaaaagggtcttcaacaagacaccctgcaaatcccaagacaataattacattcttgggactggaaatcttgcatgtttgcagacattttagagtttggcatttgtggctttttgcacactatgaaatatttatgcattgttcaaataaccctgcttagttaccattggatacctactgttgtacaggaattgcatttagaaaggaatagaatctaatttataaaatctataaagctctcatactcagctacttcagtagaaatccttttgagacaatagttgaaaatgctgggaaatagatgttaatttggtttgggaagttttttgttggtggtggtagtgaaagaagataattactatcaatattttcactctcagttagaggacatgaggttgccaatgaaatttgactatccataccagaaatttaaaaaataataattaatgttaatacaagtaatacattttattaacacaaaaatatataaaaatagattatttataactaccacctacagaaaacattttagaaaatgtcctcaggatttttgtctttcttccctcccttccttcctccctccctccctccctccttccctccctccttccctccctccctccttccgtccttccttccttccttccattcttccttcttccttccctctctccctcccacccttctttcctttcttccctttgtccatatatccatccatccttgtatttaaaacatagcattatattaaacattaacttttcataaccaactttttaaatgaagcaacatactttgaatgttttccatgccaataaatatacctctacttcatgagaattttatttcattttgtgaatgtcccctgaattatatatacgatctcttactattggaatttttatatttaaaaaatttttttctactataggcatttctgtataaacattatttacttatttatttattcattcaataaacatttattgagctgatactgtgtgccaggttctgggactacaaccatgttagacacagctcatgtttttgtctttcggtactactatgataaataaataaaacaagatcatttacatttagtttgaagtaacaacatttatttttgctgagacagtctttatcatcagtgacaaggttaacacagctggctattacttcccaaggctattaaaatattttacataaatcataccataatgtggacttggaaataataatatgtactcacaaagcatccatagcctatattaatttagctgaaaaataatatagcaatcatactgtcagactgcctccacagccacagtaaattggtgctatcaggctcagaatttatcttttcatagattttggtttttttgatcatttgtggttttgacacatatagaggtttccgctcagagcaaccaggaaggtggaaacagtgtgacatcacgtataaagcactggctgagagccagggattttcaatatgaaaccaagttcaactaattattagctacttgacctttggaggtcatcaaatattccaaagcttcagtttcctgctctgaaaatgagagcacagtgctggataatttcttagtttctgtcagtctagcaattttgaacctgtgcgtttttcattgtttttactggaagttaacagtgaaatggtcaaggaccctgttatgaatattgattccatctgtcaaagccaagctgagaggtagggatggcaaaacaacaaatacaatgagagctctgagccaaggagtgatttgatatataaaattctaaaagattatcttcactatatgtgtttgaatacactgtagaaagtcaaatgcagaagtggaaagaccagctggaaggctattactgttgacaaggtgagagattgcagcagtctcactggagatggtgagaaacggccacattctggctctatgtaatggtagagctgatcggacatgctggtaactaggatgtagggggagagggaaggagatgttcaatataactctacggtttttggcccaatcaactggttatatggtggctgccattcactgagtggagtgtcctgaggttttcatgaggatgagtgggggaggagagtcaatattttggttttgcacgtgctatgcttgaggcacctattagacatacaactggaaatgtttgaatatgaagctggatatgtgagcctgaaactcaagagaaagttcagggctagcaatttaaatttgggagttctcagtattggctaagtgatcgtaaggcaattaatcttgatatgcctgaatttacttatttgtaaaattgaggtaatactttttgtgaagtttaaatgatatattatgaattttataaaattttcagcacactggctgttatgtagcaagtagattataaacattagctgttcctcttcattacaatgatggaagtataggtggacagattggtgattaattagttaataaacatgaacactctttaaatctaattcagaggtttggaccatcttgggaaagacagaaaagaagtttatctggtttcagtgtagggtataagagagaaggcaaataccagacatttatttatattagtagttggaggcatgcgggttattaattacaccttccagggaaacccaagccatgaattccaggggaatattatcatggttgactctgccaactccaatctttgtggttgaaatgtggtcctgacccctcttgcctagatggaaatgttaactagaaaagcctgtgtagttcctgaggcactcagagagaatcctttttaataattcagccatctgtatttagctggtccctcaatgtctgggctaggtcttgttaggaataaaggataaaatattaaagggacaaatgtaaacaacactggcttgaattacaatttctagtttaaaaacatgttcatgactcacagagctattatacgtgtgatctctgagaatgaaattggctggctgacctcctaagattccctcttaaacacgaagtgaatatttcactataatgaccaagactttgcagttgaggttagcagcttgagcccttctactcactaagaattccttcattcgttcaatcaccaaagatgtgaagagcaactaatgttagccaggcatccaaatagctgagaatttcagtgtttttggagttgtgacagctgagttgtcattggttaataacccaagagtcttctctccaacacataaaacaaacaaatccctgcaagatatgtttctgtcttttagaatcaaacatttattctgagatgcttacagattcacgtgcacttgtacaaaataatatagcgagatcacgtgtaccctttactcagtttcctctaatggtaccatcctgtaaaattgtagtataatatcatgaccaggacactaacaattcatttttacattaagatttggtatcattagaattataaatgtcagattggaaaccacaactcaaaaccacaagacatgaaaagacatcttagccagtgctgttttttctgctttgtaccccatgttgttcccctccacctgtgactctgtgggtctggataggaattctgcatgtctggtggtgttttgtgcctctcatgggtgacactcagctcatcagtgattccttgttcaatgttggctgtcctttgtgactataacctcagagggcaaaaattatacctgctatttactactgtttttatggaatctggcaaagtgtctggcactcaaagaggctggatgccttttacttgggtgagagaatcaattaatctgcccagctgagagaagtgcatttctgaaagacgggtcagagacaaccaggaagttagtggtaatgctgcttaaaatcaatgttagtaagacttttgcttctttgaatccaaatctgttatcttcagaaagattctcagctaacaaaacaaccagaatatttatgtgttcagacacatgggaaaaataatattttttaaaacaatccaatctgagctaagtattaggagagcactgaaatgtcttgaaatcaagtctgaagaaataatctgcttcagaatagctttcttgatgaggaacactttttcgttgtctaatgttgttctaatcagctggacaatcttagctgaaagatttaccctataaaatgacaatataagttagtatttccctaaacctttcttttcatcaccaaggacacctacagacttctctctggggataatggaacattgaaaattgggcattttaaataggttggcagttatctgaaacaagtagtctaataaagaagtatgcccttatggctagccctgagaacaaatggtatatcttaaagttagtatgtttattgttttttccattgaaaagtttggctttttggagcacaaaatagctggctgactttctatccattctcacttctccagtgctttaaatcataatatttaacttaattatcagtatctgacttgagaccttccaagattcctcagtctgccaggtgctttgtttcttggcactgaaaagtcatttggtataaaataatgagcaaagcaaacatggtatctgactttatagagcttattttctaatataaggaacagatcaaaatcaagcaagcagatcaatgaattatatactcattaattttgataaaccactacaaatgaatgaatgaatgagcaaactgaggatgaaaaaagcagccctgagaggcaggagccagcctcacacatgcagtggggccatgttcacctggctaacccaaacgatttcacagaacatcaatatcacacaagaccatgctgagatgctgggatcgagacaagaactctaatcatttaagaacacagacaaaagcataaacattttccaggccacaaaaaatgaccaagtatctcctataacagtttgaatgactgctggtttccttaacagttttcaccttgtcctgtgttttcatctcctaagtaagaattattaagatacccagtcacagaattatcccagcttctagacaacatccagttcaaagcaatgtcccatttcctggaattatctcccaaatcacaaaacataagcccaaattctgtaataagccctctctaatacccaactcacctcagtcccaatggcatcagctctccctcattgcagcaagtgaataaacccaacattgttcaaattaaggtgcatttttattggtctttggcttgagagcattaatgaatgaaacacacaccttttttttttctgatgcctaaagactttatccctgattgaactgctgattctagatttgggataaaacctgacaaaatgtaaatatacctgaagaggaaaatagctcagtcaacagtgacttgttatagagaaaaagtcagaaagatctagaagcctaagtggtatttagagaaaaaggttctgagaaggtggaggtcagcacatattcttacatgctttgggtgaaggacgacttcttgggaagaagctatgaagaacagataccagtgtggggagagatttcaacttttcaagaagagttttagaccagtgataaatggacaagaaaataggaaggaaagtgagtcatgttctgccagtaaattcctccttccatctcaggtaaatctttcatggggcttattaagcagttttcattaaagagtttataggtacattagcaggcaaaagaacacttctttccaacaaacagctctcagaagtcataaacagaaactcctaatatctggacacccaccagaatagcaatcgcactccccaaatgtaccaaaataaaatcagcagcccccatgtgcatacagaagaaggcaggataaatcataatggctgagttagtatccctttaacccagagaccaagatttacacactacaactccgttagctttattgtctctgctgaacaaggctggctgggaaaaacttaattttaagtattttattacctgctagttttaaacagtctctttcaggttagctcagtttcttttggatacataatcagtcagattaataaatgaaattcactttatgtatgtttatttcctctcgaaagtcttccctgtccttcctcaaaatcctgggtggcattaaacaaagaaaaaagctttcgtgtactctcagtgttggaggaaagaatgctggagtgagctgtagctggactgttacctgggctcttcttggccttcattgagtttaattcttgtccggcctggtcactgagcctctttctgtatatgtctctcaaattcacagctgatgaatgtgttcttcccacctaggctttccttcctacttcctctttcctgtcccataacttggtctaatttcactacctttgggtctgagccatgatgatgttaaactagtttccatcccccttatttcagctctgaggaagaccttaaaaacttccctagcacacccatggcaggcccttcttggttcttaaatttcaactactatttattgtgcctaagagatcccagaaacttttagatctttcttatattatcccaatcatcccaatctttgcagcactgtggtgggatctcgggaggtaggtcagtctaatgggtcactttctgtctgactatgtgatgtggccatttgtattcttctgcagctgctccaggtcagaaggttgcatattgctagttgcattcccccagagctataggtggaaagctgcttatggcatcccatatcaatatatcttgtgtttttattactccccctgaggattggctaccaaagttggataaaggttgatgaaaaataagaatccaagtttcttatcacctggaagcattctctgtttcccccttaaatgagaacttacagtatattctatcctgagtttcctctacccatggcatatagaaaaacctcatagatctagtcaccaggcctgtctcttgatatggaaaggaagtttttgcaatttacatatatttttctctttttgacaatgcctgactgtcaaaactattttcatgttatggactcaaaataaatctaatttgacagtcaacatgtataaggattttgttattgtagatgatgcctgttctttctctcaggtgctgaaacccattagagtggggggtggatgcctaggatactgtgatttaagatgaatgaaaaatataaaaaatataccagtttaacatgttcaaaaatatgatacctaaaaaaactctaattccatccatcatgatttccaactttggtgggtttgtgggtgttgttattcttcatcttctctgagccaaagaatccttctctggcatcctaagtaatctgtttatttattgactttgttacttactgtctcacttcctcaattagaagatgaggtccacaggcagggctcttagtctattatattcccggaggtatctccagttcctggaacacagtagggacttgtaactatctgttaaatgaaggaataaaagaaacagactttcctacgtgcattttatgacaaatattaagaaagtcagattttgtttgtatctgagaaagtgaattgttaataatatttgctgaagaatgcttagaaagtatcagttaggtgctgaggttacagtagggaacagacatactgagccagttctcatggaaggatagaaggagagagatcaatttttctaatcctagctctggcaagttatttaacccccatgagcctcagtattctcaagtgtaaaatagagatatggccacctaccctacagtgttgtacttatatcacaagtactgagtggatgttagtgttcttgctgcttcactatcacaggtgttaacctatagggtgatgtgaaaagtcagagaagagaagggagaaaaaagaaattgaacacaaacttggtcctctatcataactggaagttgctttagctcctgttggtcatttttctctgattaacaaggagtcatcttgtagaataactgttggtagttccagagaattactcctatggcagactgtacaaggtcacccatcatggaaatggcctgtgaccctctcagaggcccttaagtggcttggtttcaggcaggtagcattctggttctttgtcttccagccagagagatctgattggctgttttccaaagtgggtttacagctccctggacactcctgttcttcccacgtttgatatagctcttaggttctaacctctgccacttacaagttctctcatttctgacatcccatgagatgcaatcctttgatcttgatatcagttgaaatggaaatatctctgagtttcatttaagtggtgtcattttaaaaaacagtttttatcaattcaaagaatgctatttggaaatatttttgcaaagagatacccttgcttcgtgctattcaagcctgtaggcactcagacataaaaagctttctatgctggtcctggaatattgggttttaatgtaataggtttaatgtcttattgttaaaatcaggacccactttccatggtgttatgtctttatgctgcagagttttcacccaaaaattctcatgatagccctcacagattttaaggaatatttagcttcccaaaatatgggctgaggaaatatttgtaagacatggtcctcacccttaatcagattatctggtgatgataatgatgatggtggtgatgatagtgatgataataaaagtaacaacactactaattcgtaacatttattgagcacttacttactgtgtcatctcagacactgtgttaagcactttccatgcattaattagttaattttaaggaagtatgtttaactttacttgtttatttttattgatacataatatttgtgtatatttattgggtacacataatattttgttacatgcatagaatgtgtcatgatcaagtcatggtagataggctatccatcaccagaagcatttatcatttctatgtgtcgggaacatttcaaaacctctattctagctattttgagatatgcaatacattgtttttaactgttctatctaactgtgtttgtacccattaaccaacttcttttcattctccccctcccactcacacacactttccattctactgtcattctactctctatcattctaccctctacctccttgagattaaattttttagctctcacatatgagtgagaacatgcaatatttgtctttctgtgcctggcttgttttacttaacataatgatctccagttccattcccattgcttcacatgacaagatttcattcttttttatggtcaaatagtattccattgtacatatgtaccacattttctttattcattcatccattggtggacacttaggttattccatatctttgccatccacatattaattaatttaatcctggcaaaattgcccatgaatgaatgttctcattttacagatcaggaaactggtgtcagagaggctaaatgacttgccaagatagtagagctgacttcagagaatttcctttattaagaatgctttggatacatcatcttattttgttctttcaacaatcctgtaaggtaggagcattagctacatttttccagctggggaaactaaggcttggagaagttagttaacttctccaaagtcagacagcttgtattcacagccaagctgggatataggacaacaaagcctgtactcttaaattacaggctaagttaacacctattatagaggcatgttgtctaacaagaaagacattgtcattaacatggagtatgtctagataatacacaaatacacatgcacacacaccctgcaccttaagagaattagaatcgcaaagcacttttatatagcttagaagtgagagtttgggaaagttattctcagaggtaatggtggaaagcaatcagatagattggagagtttttgaaaacacctaattacaatccagcaggtgtatacccctaggcaccttcagcaggtaaaatggtatctggggcctgattgaatatttctttcactaggtgttcctttctgtctacattgtgcttctgtgagctgagagatttaataacagatgctctgggatgattcctaagcaaaagaattgtcttttgtcactgtagatgcattttccgaccttgtgttcaccatgaatatatcataagagaaatgatcgcctgacacacaagcaatgggaagtgtaacctggggttgggtttcacttgattgtaattacagaatctcagcttcattaacatacgtttttatacatgaaactttttttctcatagtagcccttatttgaaatgaacacctttcagcttcaaggccacaacaattatgttcaggttgaagagcagtttgtttctacttatgtgagagtaaacaaaacaagttattgtctctgttttccttccccatttgtgtttggttctgtgtttgctgcacggcacaccaatactaaacacttctcatttgtcctaaagtgagcattggatgaaatggctctatgtataatatgggtttgtattctgttgtctcaaagcagttacttagtgttttgaatccatgtcgatttaatgatcttattcattcaataagatatgagaggaaggaaggcaaacatgtcccctgcctgtatgtggcttatagtctggcagaggggtaaggcaggatattttgtctatcttgttcactgctatgcccagtgcgtgcctgggacttagtgctcaataaatacttgttgaatgagtgtatgcacaataaaatagattaagagctatgaaagaaggattactagaggaccatggaaatgtacagtgctggactgatttcctgcagggaagggaataaagagttgaggcagatgctctcagaaagagaattcccacagcatggcacaataaaatatggcccccattgtcacgtaaatgagagtatagatcctacttccacatttgccaggcctgaaagtgttgacaggttattcctcccaagcctcaggtttctcaattgtgaaatagaaaattatgcatatgatgctcttgttagtgaccagcacatgatggacagtcaatacctgtagctactgttgactgcaaagaacctgttgtggtctcactgtgcagaattatgttattcctttcaaatgaaacttgcagtagattcagtgttttaacagaatcgtgatggaagtcaataattgaatgcatcaaatgggggaaaaaaagcacaacctctcaactcgagatattttaaggtgtgactgtttttttttaaatgtttctgttacatgcatctaaatgactggtgtcttcttaagaagagcagaattttctattatgctgtgccacttctgtcttttgatttgggggaagttgctagatctcccagaggttcagtttccaataccataaaatggaaagaataaaagtaaatatataaaggcattaacttctatatcttagtgagtttttactaggcctgtgtctgcctaggatcttcttttttgattcatctattcaccaaatatttagtggcctctggtgatatgcaatgcattgtgccagtcaaatgatgagatatctgcttggaggagcaaaagatagggtggtgggcagagacggacttatgcaaattattccaatgaagggtagtaagtgctatggtagagggagatacgaatgctatgagcatattactaatagccaaagcaatcctaagcaaaaagaacaaggaggtatcacattacccaacttcaaactatactacaatgttgcagtaactggtacaacatggtacgggtacaaaaacagatgtatagaccaatggaacagaatacagaacacagaaataaagctgcacacctacaaccatctgatcttcaacaaagcagacaaaaataagccctggagaaaatgactgcctattcaatagatggtgctggggtagctggcaaacctcatgcagagggataaaactgaactcctacttctcaccatatacaaaaattaacccaagatgaattaaagacttaaatttaggacctcaaactgtaaaaatcttataagaaaacttaggaaatagcattctggatatcaatcttgggaaagaatttacgactaagttctcaaaagcaattgtagcaaaaacaaaaattgacaagtgggactcaattaaactaaagagcttctgcacagcaaaagaaaatatcaatagagtaaacagataacctacaaaaggggataaagtattcacaaactatgaatctgaggaaggtctaatatccagaatctatcaggaacttaattcaataagcaaaaccaaaatgaccccgtttaaaagtgggaaaaggacatgaacagacacttctcaaaagaagacatacaaattgtcaacaaatatatgaaaaaaatgctcaatatcactaatcgtcagagaaatgtgaatcaaaatcacaataagctaccatctcacaccagtcagaatggctattattaaaaagtcaaagacaacaggtgctggtgagtctgtggagaacacttatacactcttggtgggaaaatgaatttgttcagccacagtggaatgctgtttggcaatttctcaaagaactaaaaacagaactaccattcaacccaacaatcccattactaggtatagacccaaaggaagataaattgttctatgaaaaagacacatgcacttgtatgttcattgcagcactattcataatagcaaagacatataatcaacataggtacccatcaagaatggattggacaaagaaaatttggtacatacacaccatggaatactacacagccataaaaaagaatgaaaccatgccctttgcagcaacatacatgcagctggaggccactgtccttagcaaaattaacacagtaacagaaaagcaaatatcacatattttcacctataagtgggagctaaacattaggtacacatggacataaaggtggaaataatagacactggggacaactagaaaggggagggagggagagggacaagagctgaaaatctccctattgagtaatatgcttactatctagatgatgggatcaatcatacccaaacctcagcatcactcaatatacccaggaaacaaacctccacgtacaatccctgaatataaaataaaaattgaattaaaaaagcaaaaaaacccaaaagctataaacatgtagaaaggtcaggcacagtggttcatgcctgtaatcccagcacttagggaggctgaggcatgcagatcatttgaggttaggagttcaagaccagcctggccaacatggtgaaaccctgtctctactaaaaatacaaaaattagccgggcatggtgacagggcctgtaatgctggctacttgggaggctgaggcagggcaattgcttgaacttgagaggtggaggttgcaatgggccaagagcactccagcctgggcaacagagggtgttggtttagcatgggactgtcatggccaccagattggtcttttgctttctgaatctcatttccaaatttagtgtctgatactgcttgtcaatacgtctttcatgcatgtttagactccactcagctcaattccattctaagcattcttttgtcatttatcattcaatgattccagctatctattgacccaatataaatctattaatcaataaaggcatatttcctgatatctctttcaataattcaataaagggatattttttgaacataccttgtgtttcagatactctgctctgaaatcaggaatgaatgagatttcatccctcttcttaagaatcctccagcctaggaaatgatgtaggaaagatacccattacgatagcacaagacaaaacgtgatatagccatcagcaggaacaaaaggtgggaaaacaatatatgttggcacacctagccagcatcacatgtttagttacctgttcattcactttagccactagaggtttagacacctgttttgttttgttttggtgggaggttgattttatttaatttttattttaagttcaagagtacacgtgcaggtttgttacataggtaaacttgtgtcatgagggtttgtagtagagaatatttcatcacccaggtattgagcctagtacccattagttatttttcctgatcatctccttcttcccaccctccatcctctgatacagacccctattttagatatgggaaataggagaggtcaggccctcaaggtaggtgtgatttcaaaggcttgaaggtgtgatttctttttttatttttatttttattttatattatatttttaaaattttattattattaaactttaagttttagggtacatgtgcacaacgtgcaggcttgttacatatgtatacatgtgccatgttggtgtgctgcactcattaactcatcatttagcattaggaaccaacccaaatgtccaacaatgatagactggattaagaaaatgtggcacacatataccatggaatactatgcagccataaaaaatgatgagttcatgtcctttgtagggacatggatgaaggtgtgatttcaaaggctttgaatgacaagtcaaaaggttattcagtaggaatagccttccatgttttgaagaggaaaaaggagcacacaagcagtactaaaaagcaatacttcccatgtcttgtgagaagactgaggctgagaaatgcaatggagaactgagaccattgctaggttctattggagacggtttctcttgggaagacttcaggtattttagagtagagtcatgtcatggagtgctctccaaaaactggcaaattcctcctatatccaagcagaaattttctttacttttggacaactcctgatgcttatgtgaccagttactccttaagcatattttttgagacccagattaacacagatctcaaagtggatggttccagatagagaaaattgcatgaagaatgctaagtaggtctagattcttcaaggtgcggtagggtcagaccaattttttaatcaagtgtcttgtcaaaaataaaaatgcattacagattttgtttcattttttacaagaataaaggtgaaggtgttagagtagctgatacctttttgacattttgactctggaagttattatgcctttagattcagtggaaatgcttcctttatttcctcttacgctaattcattttaggtagaaacgtcaatgttggcctaatatgtgaggccgatggcatctcttaacgtttaaaagtctgttaactctcctactatgaaagttctaaaacctctgtccaattctttaaatactctgattaagatttaaaaggctacttttttactaccatttaattatctacttcccaggtaactgtgatattacaattttgcaacatcctgtagctctttgtccaaccattcaattatgtatatagcaagatttttaccctaccataattaataggggaaccaagtagaaacattaatgtgaattaaccgttaaaatgcacagaaggctggctctcatattttttcccatactgaattcctggagttttacccaggggtgaggctcggatcagcactcctataaaaaattgtcaaacttgctgttatatactatgattattataagtttattggtacatttctaagtagataggaaaaagatgcctgaacttgcaggttatctctgcttttaacttgtttttaccattggccaggaggcaagttatataacctcttggattcttagatttctcttcaattagttacagtctgtaccacctttagaccaggccaactagccctggcacaaggtcttgggcttaagggtccagctctggctttcttatggttgtgctcctatgaactaagaatgcttgggccaagggctgtgtccatccagaaccagtgtcctcctacccaaatcatgttctgggtactggagaccctaggattctcagcataagtggccctgaatctgtttccagtttctttcttccctgagtttattctcttaaggtcagagaagaatgctgggtgtgtgcatgcatgcatggagtgaccaaggactatgcattacccaagtttggagataaagggctctggtgtccaaagtcatgtgttctgttccctgcagtgcaggctggagccagaggtgaggatgaggggaagtgggttcagaagtttcaatttgtactcttgcttcaggccctgcaagtgttgaggcagatttggttagaactgttaattcccaccttttaggagaaagtgcaggggaattagctgcaggctgcaggaagggctgacccaacatatttgaggaggaagtgttgtatggtaattgtggttaaaggtttccttgtttttaaacatgcttattaattatatgtcacagtaattccagccttagctgttcattcctaagttcagacactaaatttttgttaaaatatgaataattattaaaggggaaaatacatctttattattcagcagaatcaattaacatatttgcatgcatttgttttattagccagtcacctagaaaagctcagaggaaaagccacaagattagtataattcactcatgttgaattaataagtgtctggaagagtatcagaattccctgaatctgctaagcttttaagctttagcacgctaattgtcatcaccaccgctactaccatcaccaccaccaccatcatcatcatcaaaataattaaataccagtagctaatactcactgagcatttgttatgtgccaggctctgtcctaaacaccttacatgaatcacaaccttcagttctcattgaacctatgaagtgggtacttttattacctcatcacacagatgataaaacatgatgcacagagaatacaaatgattttctcgaatctcagagttcctacctatgaaggtagcatcaggatttgaacccaggtcttcagacagcttcttcccattgacttaagtttcccactttatttgcatgtgtctttcatcagcctgatttactgactcatcctttatgtgtctccagtgcatcacaggaatttaaagtgtaatgttagatcatcttgtgtataataattagtctttactgctcttattataataactctcacattctgtactcatggctactttataccagtctgattctggtcattaagaggcagaggggattaaaaaaactcagattaatatgggtctattgtgtttatttagctaactactagggtgatgaacttagataaaataattacaaggacaattgtctaagaattcttacatcattcaattaagtctttattatcttttcaagtgtatgataaaatatataaattttaaatgtggaaaatatatgtaaaaattgtaaaatatattaacagaaaaatttattactttttatttatataaaaacaatatttgattacttttattgtggttaaaaatatcacattcctagaatatatatagtctgctttaaatggaatatattgtcattaaattttatttatttttaaacaaattacattcaaatgaattttctcttttttgagggagtggaactaaagatctgtaactctaaaccaggaattggcaaactatagcctagaagccaactctggcccagagccttttataaagttttatttataaataaataaataaagttttatttgaagatgaccaagctcatttgtttacacattgtttatggctgcttttgtactataatagcagagttgaatagttgtgatagagaccttagggcatgcaaagactgaaatatttactatctatcctttgtgggaaaaagtagtttgttgacccctcctctaaactatgtgtctgtagcagtctgcttttgcattgcaataaaagaatacctgagactgggtaatttataaagaaaagaggtttattttgagtcacggttctgcaggctgtacaggaagcatggtgctggcatctgcatctggttaaggcctcaggaagattccagtcatggtggaagcaaagggagatctgatgtatcatatggtgagagcaggagcaagagagagcaaggaggtgccacactcttttaaacaaccagatctcatgtgaatcttcataggatgagaactcattactgtgagaacaacaccaagccatttatgaggcatctgccccaggatccaaatacctcccaccagactccacctccaacattggggatcacatttcaacatgagatttggaggggacattcaaaatatatcagtatcaaaacaaaaatattggttggcacacattccagtagtaccatagagtcccctaacatttgagactttgcaaatggacagaaacacagtcgtgtcaaaataatttttagactctaaaatgttcagccagttaaacaaacatgttttattttattgttaccagaatttgaaaaatatcacaaaatcaaggtgaggttatcttaatcctatgactgctctttaagcaaacaatatgtttttcaaaattgaccaaataaagcaaaagagatgaaaaacaacaacaaccatagaaggtattgtgacaaaacacagaatcaagtatttactttgtttaatctaaagcagaattaaaatgggagaagataaataccaaatttcacgtgagaaataactattttctgctaagtaaacttattaaaaaaatacagtcacacttttttgccactaacagaggatcatttgcagaggcttgtctctatgtctctattaaggggatacagtgatgttttcctaccttgattagattattcaataatttctttgcaagagatttcagctgcctccctatgtaaaccaggcctaatctatctggtatttacaggttaatcccttaaagacttgtggacaggatatgtcagaaactggtgttggcttgagagacagcctactgtaggtaatgcaagtgttgcttggtaaatttgatgagcctaattcaaccacaattttcaatatctaatattttattcccaggtatgcttgtttaaaagaaattttaaaatgccaaaagaaagcccttctatctaactttcacacacaaaaatcacatggtgataaacacaaaagtagatttcaaaaatgttactgggacaatttggaattcatatgcaaaaaaaaaagaacgaacgaaaccacaaacaaatactctagccatacttcacaccatatacaaagattaacttgaaatatataaaatactaaatataaaattagaactatgaaacttttaggaaagtgctatccaagtggaatactgaacaatgatggaagtgatcagcggctgttctgtccaatgcagtagccaccagccaaagaggctattgagcccttgaaacgtggttagcataattgaggaactaaagttttaatttaatttgatttgatttaatttaaatttaaggcaccatatgtgactggtgattgttgtgttggacatcagagttttagaagaaattatagctaatacatatttgtaacttgagtaaggcaacgatttcttagggtgaaaaagaacaaacaatgaaagatgaaaggtaaattaagctttatgaatacaaaaatctatgctttataaaatacactgttaagaaagtgaaaaggcaagtcgatggactgggagaaaatgcttacaatgaaatatctgctaaaggacttgtattcagaatttacaaaacattatcagaatgcactactaagaaaaccaaatgggcaaatgatttgaacatatacctcaacaaaaaaatacagaaaaaggcaactacacccaagaaaaagtgttcaacatcattagtcattagggaaactcaaattaaaactgcaagatataacattatacctctaaaagaatggctaaaataaaggggaaaacccctaaacatcaaacgctggctaatatgtggaggagctgaaactctcatacattgttggtaggaatgcaaactgtcaaaacacctttgaaaaacagtttggcagtttcttataaagtaaaatacagatttaccatattactagcattgtgctgcagccaaacattaccagttcataggagccaatcatgcacatctatttctaactccacattcagtgatgccatgttgggagactgaagcggtttagagtaggagtatttacactgcaggaattggcaaatgctacaaatcagagactgttttggggaaaggggaagagtcaactattaaatgtctaccagtaaagtaatccatatggtccagcaattctagtcctagtgaaatgaaaacatattcatccagatacatgtacattaatgttaatagcagttttattcatacttgccccaaactggaaacaatggaaatgtttattaactggtgaatggataaacaaatttattacatttataaatgaaatattactcagcaacaaaacataatgaactactgatatatgcaaaagcacacactctctttcctttaaaaataaaagcacaaacatgaatgaagctaaatcttttctttgggatctggttctacagtattttcttctaatgttttcaattgtcacaattgtttggacctgaaaggtacttctgaactgtcaagcgagctatagttgctattagtccatcaaatgaattttagagatatgtcatatcttttatgagactaaagagcttagaattctccctctcaattaagtttccaggagtggctgcatttaatatgatttctgatactctgacatagcaccaattaacagagtctagttttaaatccaaattcaaagagcaaatgtcttttagcacataatttaatgtctattccaatttaccacttgtgtttttgttgattttacagaggcccttggatggttctgccctagtcattagggtactaattctgttaaatacttgttaagaactacattacctactcatgccaaaccctggtgattcaatgctataacgtatgggtgaggaagtgcagaaaatgacaggctgattggattttgtttttctaatcacattatgttctaatacttctgaccaggttgtttaaggattttataaaaatcaccttttacagaagtcacctttcacctttcattattgtataactttatgagagagatgtgtcaaatggtatataatagcttattatttttgtcctctaaagtgtttatttcacgtcaaaaaaagtagaaacttgttagataagagctgtgagagctccttttgaatgcaacaaactagttgaactgaattgtattaaatattatttttctaatgcatcaatggtcccaagacaaaaaaaagacaaaaatgtttgtttacatgaagtaacttttctctatgaaatattcaatgtaataaagccaagatagtaggaaagatgttttatttgaaggtgtgtgtgtgtgtgtgtgtgtgtgtgcatgtgtgtgtgtgtataaagtagtgaattaagcattatgacacactctagccactggctactgtgcctacggtattaggcttgggattccacaacatttgttggtgaatgccctgggattaaggttcctggaaatcattgccaaactagacaggaacaaattaatctagacagcataaagcttgacaagcacattagtaatttttaacatctggagaatactgtcattgctgattagatgaaggtataaaaatatacctaaatgaaatgttcaaaacaaaatagaatatgatttttaaaatttctgagtagcttaatttgtcttttattattataaaaacataatatgtaaatgaaatactaaaaacagagatctagaagtagaaaataatatttaaccaatcccatttcactctgtagaagtgacttatacatatatatgtatatacagagagattttaaaaataaaaattctatcatgttgccatattctacacattttttttcaattgctaatttatcattaacttcttccatgaaaatacctacagatcttcctcaaggatgcatataatgaagctctaaatgtacttagccaaagccctgttaatgaatatttaaagtttttctctattatggtgtgcattgttgactcgattatttgcttgcttctgtgacagtccctttggataggttagaagcagatttttgagttgaaaagaaaaaaaaggtgttttcttgagaaggaaattgggttatattaagttggagatttggagtgaaggatagaaaagaagaaaattagattgccataggaaggctgatgatttatgtgtaagatccagtgctgtgtgttctccgtttcagcaatgtggcatcattgtgcgacatactttcatgtgttatctgttcatattgacttgattttttaatcaattatgccattttcaggcatacttctttaaattggaaaaaaaatattttcagattatctttgactgaagtttaattgcatggaataaaaagaatatcaaagtggcaaatgctatgtaaaaaattaaatagagtaatgcacaagagcattggtaaaggaggaagactttagctgaaatgatgagtgaaggcctcttagaagaggtaatattccaggagaaactgcatgaccaagaggaggctgctcctcttgatttatgaagaaagagatttactaagaaaattgttgttgttgttgttgttgttgtttttcagataaaggaaactatgagtacaaataaactaaggaaggaactaatttggtttattcatagaacaaaagttatttcagtatgtttagagagaatggtagaggccaaaccatggaatgccttgagtaccagaataagaagtctgatgttagaaaaacaaagtacttcaagttcaactggaagctgttagagatttttaaactgcagagcctcataatatgattcatgtgattatgtggccaattttagttttattattttttcttttttttcttcaacttttaagttctgggatacatgtgcagcatgtgcaggtttgctacataggtaaacgtgtgccatgggggtttgctgcacagatccacccatcaccttgtattaagcccagcatccattagctattctttgtgatgatctcccccaactcctccctccaacaggctccagtgggtgttgtttcccctaccatgtgtccatgtgttctcatggttcagctcccacttaagtgacaacacgtggtgtttgtttttctattcctgttttagtttgatcaggataatggcttccagctccttccatgtctctgcaaagaacatgagctcattcctttttatggctgcatagtattccatgatgtatatgtaccacattttctttatccagtctatcattgatgggcatttgggctgatttcatgtttcttctattgtgaatagtgctgcaatgaacatacacatccatgtatctttataatagaatgatttatattcattcctttgggtatatacccagtataggattgctgggtcaaatagtatttctgcctctagatattcaaagaatcgtatgtggttaattttaaacatttgtttagtgaatggattaagaaaggcaagggtggaaaccaggaggcaaggtaggacaatatttaggtcacacaatgcagattgagagccatcatgcattaagaatgtattctggaggtaggaccaggaggacttggtgatgaattgcatgtacaatgtgaaagaaagagataaactatggctatcttcctatctaaaagaggcggttctttggcataaaagtaattttgatagctcatagtgcttggaaaatgaaaaaaaaacttggagtccagagcctaccattggtgggttctattataaaccctttctgctttggtctgggatcctgaaaggtgggtggttccctgggaacaaggatgaaccaaaggtaaagcagacatcacaaagacttcatcacagtaagagttgtttgaatgcccccctcctcccaaatctcaatctctaactctagaattaatgtgatcctgagctgctagggcatagctgccaagctgaaacaaaatgataatctttcctatagaaatataggctaccactacagatcaaattgttttttacaagcaacatttaaaataaaatgtccaaaacataatcaaagataaccaggtatattatgctgctatttcctagaccacattttgggtaggtgcaatctactagtagctgacttttcaaccgaaataatggaagccagaagaacaatgagctgatattttcaatgttccaaaagaaagaaagctgccaaccatgaattccatgcccaataataataaccttcaaaaaggagggcaaaataaatatatatatagatgaagagtgagtgatttttgacaataatacccaaagtaaaaactaaagaaagatcttacaaacagaaaaagaatgttcccagagagaaacttaaagaattaagaagggattcagagtaaaatggtaaattaattatgaatataaatgacataggcagaattaaaatatataatacttacagcataaacatcagattaattgtgcaaaagtgttctaagtttcttgaaattctgaggaagagggtaaaaataaaaacactaatcagcattagattatgctaagctaagaaaatatgttttaatctttaggataacaaataaaataatttcaaaaagtgtattataattcttaaaaagaatagtaggaataaataatccatgacacacacatgagaaagagagagagagagagagagagaagaaatgtagggcaggacaaattcttggtagattgttaggacattagtagtattcttagtagattgtttacaaatacattaataattgcattaaatgccccaattaaaagccagttatttttcagatagttatttcactaaaagaataggaaaagatactccataaaaacactgactgttgggtaatcaacgtctgctgcctattatcaggagtagaagttcaagcacttctgtccattgcatcttggtatcagagtcaccaatgaaaataacacagtgaagcactggatgaaaaaaaaatgctatactcatatagagaagagacagagcaaggcaagctttaacagtgggcatctgttccctgtggtcagtgggcccctcccaacaaaactcaaaaaaggaattacgggacaggacaattatgagtcctgtctaactcatgagtgtagaagtagaaattctaaacaaataattagcgaatcgaattcagctatgcatcctgctgaatgagcttattcagaaattcaaagttgtttaatgtttcttaatttttaagggtaatgtgccacattaatggaataaaagaagaaaatcatttcaattaatacagaaaaagtgtttgataaaattatttcagagtttaaaagttcttactaatcaacaagataatttctttaatctaatacattatattggccaaaaccataaatagatattatatttaatggttaaatattgaccccctccccattcccttagagtctgggactaacaaaagatgcctgctataaacattattttttaatgttgtatccttggccctagatagttcagtaatgcaagaaaaaaataaggattggcaatgaagaaataatacattcatgattgacagatgttaaaataattaataggtgatattagcaaggttgctgaataggtaaatataaaaatcaattaaattcctctatgccaaaaataaacagaaaaaaatgaattaaaaataccgtttataatattatcaaaataatcaaatactaagaatgcaattataaaagatatggaatgttcctatcaataaaatgacaaaacattatttaaagaaatgaaaaagacctacacataaatatatattatattcatagactggaagaaatttaatcttaaagctatcaattattctcaaattaattttttagattactttttacactcaatgtcgtgtatcagtaacttggcaggtagaattttagaaattggtgagctgattctaaaatgtatatggaaatacaaagccctattaatcaagacactcttgaaaatcaacaataagctgagagcaatttttcgcaccagatcccaagatttatttgaacactacagtaactaaggcagtgttatgttattgtgaggataggcaaagattgctatagaacagaatggatttctgcaataaacatgtacacataaggacacttgattcaagagaaaggtggtgctgcagagaagtaggaaagtgatgatcttttccataaacggtgctgggaaaattggaaatccatatggaaaaagcaaactgcacacctgactcacaccatttacaaaaatcaaatccaggtgaatcaaatacttacatgtgaaaggtaatacagtaaatgattgaaaataaaatatgggagaatataagcttggatagaggaagattttaataaataggactcaatattattcattaatgttaatatcgacacatttagatacattaaaacctgtcttcattaaatgatttcataacgaaaatagaaaggttctcacggcatggaagaagaaatatgaaatgaaaataatcatcaaaaggtttgtataaagaccctatgcaaggttcctacaaagtattaagaaaaaaagaaagtcaatagaaaagtggtttgtagattagttgcagtagtggccctggccattcatttcctcctttatccatactttttgtgactttgcagtaactctcatcaaaaggtagagtcttgtgtaatttgctctggccagtaaaatgcagcagaagtgacagtgtgacagtttggggtgtagttttttttgtttttttttttttttttttttttatgagacagagtctcactccgccaaccaggctggagtgcagtggcacaatctcggctcactgcaacctccgcctcctggattcaaacaattatcatgtctcagcctcctgagtagctggaattacaggcacccgccaccatgcccagctaatttttgtatttttagtagagacagggtttcaccatgttggccaggctggtctggtacagatctctccgtgcccttagatctcttggatcccagatagcctacaggaggacgtaggagacgtggccttgtcttccccacagccccatcctaagctggccaattgccagacatgtgagtgaggccgtcctagaccatccagcccccattcagcctgtatatgccccacagaccagtcacaattagctaaacctagcctagagcagaagaactatgagctaaataatgcttattgttttaaattactaagttgtagaatagtttgtcactcagcaacagctaaatgataaaaataggcaagggtcttaaaataagttacttcacaaaagatcatatacaggagccaataaacttatgagatgatgctcaatctcattgatccttagggaaacaaaacttcaatgagatcgctaccagaataactaaaattaaagcctaacaataccaagtgctaaaaacgatatgagcaacttcgattttacatgatgctagtaagagtgtaaattggtatgaaacactttgacaaatattggcattagctaatacaattgaaaatgcaaacattttacagactagcaatttcatatctagctatgtgcatttgtatactaagaaatatatatgagtgttcatatcagtattatttataatagccctaaacttaacacaacttaaatgtccatcaattgtaaaatggatagtgatatactcatataatggaatcctataaaacagtgaaaaggaaaaattacagttaatttttcactcacatggtgaatattgggcaacagaagtcagatttaaagaatgcctgctatattattccaattatataatgcttaaaaataaacaaggcaagtaaggcaaaaataaacaataacataatttatagttcatagaagacaaatgtatgaagaaaaacaaggaagtgataagtaaaaatgtcagaacccctggttacatttagaagggaaagaggagattataattgggaagggacagccaggagccttctggaacactggcaaagttttatttcttgacttgagtggcagttacatgacagtttgctatacggtaattaattagttagtgcacttatgtgttatgcacttactgttagcatggtatattccataatgaaactgttaaagagagagaggcatcatgggagttcaagagtggcatttgtgaatctgttgcttacaacccaatcagcccattattgcttcccagatgataccgctactatgtcatctgtgaagcaaaaaaatgggttggccagataagcgttaaatctttctttatcattttggggtgctaagtgtaaaagtagaatgctagtacaatagttctggcatacagaccaaataatgagccctaggattagtgagaaatgactattctcacagtcatttaatggaacaggttgaggttttgatgtgattttgagtagcaacccacattagctaaggtgctccttagagtgctttgtttcttgctccctgaacggtcagtcatgccggaggcgtggccctgtctctcagttttgcagaccggtcagcagaaaacacagcagaatgctaaccaggagatgcctacaccttattggtttattcccatgtgctgctccccatcctatttttttgtgtgtgacaagatgattgtttatctaattcaaagcctgctcaatgtaactagggatgaattagaattgcttgtaatccttgtgtaacacatgtcctgttgtcaccacaaaacatttctgtaaaaataaaatttggggatgaaccaccctctagtaatgatatggaagaccaccctctaataaaaatatgttaatctgggctggacacggtggctcacgcctgtaatcccagcactttgggaggccgaggtgggcggatcacgaggtcaggagagtgagaccatcctggctaacaggatgaaaccccgtctctactaaaaatacaaaaattagcctggcatggtggcgggcccctgtagtcccagctactcgggaggctgaggcaggagaatggcatgaacccaggagacggagcttgcagtgagccgagatcgcgccactgctctccagcctgggcgacaaagcaagatgccgtcgcaaaaacaaacaaacaaacaaacaaacaaacaaaaaatgtaaatctgagaaatccttaaagattaacatgatatttatattatacacataaggaaattttatttggctttcttatataaataaagtgtaagtatctcaatcagccacgctacttataatgcacatatatgttggcctttgtatattgaagaagctaatttatttgtagatcattcattcaacttcgctatttctctgttattctttcaatgaaattaacattaacaatctaattattcccaaccatagttatagaaacaaaggttgtttgaccagaggtctcacctggagaactttttaaaaagtaatgctccccaagctctaccctagtttcaggtcatcaaaatttgtcaatatcgcatgatactattttgtttacctatttatctttgtctgcttgccccctcatctctgctaaaatataagcttcatgaaaacaaggacctctggacctagttcacccttgtcttccaaggcacagaacaaaggttggcaactatgacctttgggccaaatccagcccacctgcctgggtttgtaaacaaagttgtattggaacacagcattgcccattgatttacttactgtctatggctgctttcatgccaccatgcaagttgagtagttggtgacagagaccatctggcctgcaaaacctaaagtatttactgtctgcccctttacagaaaccacgtgctgatctctgatttagaaaaatggctagcgtagagtgggctctctacatgtgttgaatgctgaatgaatgaaataatcatttattagtgcctctcagcagctctcttttgcgcaaataagtttctttttccatgttagccttaattaattgttttattacactgtggtctcttcttggaaacttactctcctcattgcattattaagtacccttcattttcccttggagccagtctggggttttggttatgctaaagtacaatgagatatgggaagatatgaatcaatttacgcaaaacttctcaggagcacattaattacatactatgagattttttcccaagctcgctttcattctcagaggagtggcaacagtgtatcagattacaagttaaatggaaagccaagttaataaggatgggatgtgatatattagagtagcgggtatgatttgctataatccccagctgaatttaatgataggttatcagcattcagggatgaagtacactatctttcaatagatagcaaaagcacagtgaactatttctaggtttttaaacccgttaactctctatataaccttgggcagtgggctacttctgcaaatgagagtttcacagtctcttctttagtaaccagaaaaatctgggttaggtgatgtttatagttgatcgtaattatattgctttataaatagggaacacaataacaaatagcctgaaagtatagtggaatcacagcttaatgtaagtgttatgtcttaaaaattttcatcaatttataatgaaagttttcatatagttaaaattacctttgatctttatgtggccagtacattttttaaaattgtggtaaaatatgcacagcatacaatttactaccataaccatttttaaatgtacagttcactagtgttaattatattcccactgttgtgtgaccaatctcatgagcttttcatcttgcaaaactgaaactctataccagtggtccccaaccttcctggcaccaggaactggttttgttgaaaacaatttttttcatggaccgagggtgggatggtttcaggatgattcaagcgcattacatttattgtgcactttatatttctattattattacaatgtaatatataatgaaataattatacaactcaccataatgtagaatcagtgggagccctgagcttgttttcctgcaactagagagtcccatctgaaggtgatgaaagacagggacagatcatcaggcattcgattctcaaggagcacacaacctagatccctcacatgcgcacttcataatagggttctcactaccataagaatctaatactgccactgatctgacaggaggtggagctcaggctgtaatgcgaaccatggggaacagctataaatacagatgaagcttcccttgctcacctgccgctcacctcctgctgtatggcccggttcctaacaggtaacggactggtactggtctgtggcccaggggttagggacccctgctctatacctttcaacaactctctatttcctcctctttcccagcacctggcaaccaccatgctaccttctgtttctatacattcgactactgtagacacttcaaataactagaatcatgcagtatttgtcttttttgtgactgacttatttcacgtagcataatgtactcaagattcatccatgttgttacatatagcaagatttccttccttttttaggctgaatgatacaccattgtgtgtatataatgcattttacttatccattcatctgttgatagacatttgggtcacttccatctgtgcactattgtgaataatgcagctatgaacacagatgtataaatattttttgagatgctgctttaattctttttggtatatacacagaaatggaattgccaaatcatatggtaattctatttttaattttttgaggaatcaccatattgttttccacaggggcaacgtcatttttcatccccaccaacagtgtacaaatgacacaatttttccacatccttgccaaaacttattttcttttttttgggttttttttttgatagtagccatacatataaggtagtatctcattatgattttgatttgcatttccataatgattactaacattgagcatcttttcatgtgcttattggccatttgtatatcttctttggagaaacatctgttcaagtctttgcctaatctttaatcaagctgtttggttttgttgttgctgttgttgaacagtaggagtattttatatattctgtctattaactctttatcagatacatgatttacaaatattttctctcattccatacattgcctttccactcttgatttttttcctttggtgcatataagtttttaattttgatgtagtctaatttatctacttttgcttttgttgcttgtgctcttggtgtcatatccaagaaatcattgctaaaatccaatgtcaagaagatttcccctattctttcttctaagcttttaagtttaggtctttgatccacttttaattaatttttgtatatggtatatggtaagtgtccaacttcgttttttttttctttttgcgtgtggatatccagttttctcaacactatttgtggaatagtttgttcttttcacattgaatgatcttgcacccttgtcaaaaatcatttgagcagatatgtgagggcttatttcagagtgctctaatttgttctattggtctatatatccatctttatgccagtaccacactgtttttaccactgtagttgtaattagtttgaaactaggaagtgtgggaccgtcaacctttttcttctttttcaagattgttttggctatttgggtttcccatacataccctagtgtcttgcaactctataaagtaaattttaggtatactccatactcaagtttgagaactattaacctaggttaaagtaaggggaaaaaaggagcatccatatgcaaatgtctgctaggtgttttcagtccattcttcctttaagagaactatgaaatccttaaaagtcagagcagggtaggatgtgggagagcagtaaaaaatactcaagtggtcctgcctacctgcaagagtttgtcattcagttttcatagtaagcctccatatttcattttctttctttctttctctttctttctctttctttctttctttctttctttctttctttctttctttctttctttctttctttctttctttctttctttctttctttctttctttcttttttgagacagagtctcattctgttgcccaggctggagtgcactggtgcaatctcagttcactacaacctctgcctcctgggttcaagtgattctcatgcctcagcctccaggtagttgggattacaggtgtacagcactgcacctggctaacttttacatttttagtagagatggagttttgccatgttggccaggctggtctcgaactcctgatctcaagtgatccacccacctcagcttcccaaattgctgggatttcagatgtgagccactgcacgtggccaacctctatatttctatgtaaatctcttgctgtagtgagagggttacagagatgatacagcctcatcttacctgtggtgaggttcacaaacttaaagaaaagggccacatgaagagaaagcactacctaacttcatgtttctgtgcaacggatatttattgtgtgcctgctgttttatgaaagtttatggaagaagcatgttttctcatgagtctttggggatcgttattagaaacctatggtaggggatctcctcaggggatttcattctcctaaaaaaataaagagaactgtctgaaatactaaaggcattaatatatttttcccaggtacctatcacctttaggaatgtgatgattatttccagtttttatggacacatacctgaggaggctaattaaagaccatttaagaacttcatacatgacttagatggaggcctaaatcacaaattcaattcctgtttggaatcaatagtctcttcttgcttacagtcgctttttgtctcagctcatgtccattactgagtcatcagtattgggatgaaaagccaaaatatagatttctccaaggaaaagtatattttatttctctttgctcataatgtttcaatgcaggctgaaaaatgcttttttataatgcatcttattctaattattcacagaacacattttaatttagacttctcaaatgtacattaatgtgtgtgtgtgtgtgtgtgtgtgtgtgtgtgtgtgtgtgtatactatgtatatactcctaaccagagctcctatgagttaactcaagtcattctggctcaataatttttaaatgatagagagaaaataagacgatttccctgtgtttttgaaaaccctggcagaactcattattctgtgtcactggatctttcacatatgcaagtttatttttggtgttccaagaaatctgaagttcactaacaaggtttttgaagaacactcttgaactgaatgtacaggctgtagttgaataagaacagagtgtgtttggagtgcaaatgaaccagctgggatactaaattctcatcatgtccctaattcaataacatgagtttttctaattcttttaaaattatgtagtgttcatggctgaatataaaaatactagtatataaatgtacataatttactattttgttcaacatcatacctttgtcatctagatctatcaaaacgtagcatacactgccatttatatcaattgacaatgaattcaaagaggggtgtccatcccttccaaagtttaagtgtggttcttacttaaagtatctgtaattttgcaggcatcctggaatgagttctgtaattttgctgggaggagggaagattaattgcaggatgtttataactatattgaggtattttgcattcattaataatgccaactaatgtttatagaacactcaatatactctcaaaacaaagcactctgctaggcccttcgttgtattgttcttttacgttcacagctatctcatgaggtgggtactctttttaactccattttaccaagaaacaaatggaggtctgaatctgggattcaaacctcattctgtctaactcaagagtcaaattttcatgatactcttctctgtctaggtctctgatatgactgttctttatatattttttttaattctgaggctttctatgtaatttaactttcctaatgattttgagtatttcccattccagcatatggccagcatttcatgttcccattggcaatgacaccaacactaggagaagtgacccctgcaatgtacaaatttcaaaatgtttataaacacacttgaccagaagaatgttttatcttctgtgtaatgccagttatcaaaaattaaataatcacatgtgttctagaggaagtgaagattgaaaaagaatcgcaaatgaagacaatagaatgaaaagattatatggatctagatgtaaatgtgcaacttaagcaatccacatgacaggaacacttaatcctgtatcaggagagaaaatgagttaaatatgaatttaggaccataccctaatgaaattcaatgtcaagataaacctaatagtctgtcattggcatactttacatttgttttgtaaaaggcaaagcctgaaaaaaagcaagttgcttataatcccataaatagaacttgaaataaataagaaatttatttttatatgaagatttcagttgcttttaccataacttgcttcatgtcatttctgtatatgtgtgtatatatatatgtgtgtgtgtgtatgtgtgtgtgtatgtgtgtattatacactagatttttacattttcatatgtgcatctgtattttacatctatatatattaaatatgtatatgttttacacacacacatacaccaaattttcatgactcattagggagaggtggctaacctactagaaagagcagtaaagaaaaaaaaaacccttttttttccaaaaatctgtctgtagatttcttccttcctcccttcctcccttccttcttttcctccctaccccagacatttcttgcacaaatgtttcctcttgccttaggaaaatgtatgatttctctcttgatgacactccatcaagctccttcttaggtttgcatccttagatgctaagatgcattgtgagtgcagaagagtggaggaaagtagaggcactcaccagggagaaggggcgacaggagcacagagactgggctgttgccttcggaatagcatctaagggcttggcaaagggtccacttggtttacatatttctcaaagtacctggggaggagggatgttgtccaataaaaacacacggatgaaggacactgaagaggaacatggagagaatggaaaacagtcatttcctcttgcgcaactttgccccaatgtagaggagtcctgcctgagataacatagaactttccctactatattgcccaaggagacatagtgggttgacatgtttgcagtgatctccagtctggtaagactttttcacttttctgaaaagagatggtctgcccttgatagttttcattaaatggttgaatctatttcattcagcatgatttcatctcttcccagttaacacagtggcttggtctaaagttgcctttagtaaccaactggtttaacattgtgtccatgggaagtatttctaaatccacgtgattgttcacctgaaatttggtttcagattgaataataaactggttatttgtcccactgcaataagccacttttgctttctgtaaccagatgctctaggaggatatctaccctgagtttatactctgacaaagaacaacacttttttttccaaaaaaaaaaaaaaaaaaaaaaaaaaaaaaaaaaaaaaaaagctttcttttgattcactagaaactttagctatcactgtccttcagtaatcttgggtttttaaaaaagcttcctcaggtcagaccattggactatgttaggtgtgagggtctggagtccttttaatgttgaaatttttgaagcgtttgctgatttgattatctgtgttagccttcatgtatagagagtttgagggtttcttttttttatttgaagtaagttaatgttgccttcagcttaattaatgaaagttttaaatgtgctggctgtaagccttgtcactcgatggtaacagggattttataattattgggggataaaacatgacagaagcttcttctattttctttctgtctggtctcactgttcttagcagttgatgcagctttttgtcactctgtactttctgagaaaacttcctggctaatatgggagttatcagataactttacgtggtctgcctagagatgtctgtatgtggcccataaggatgctcagtgggttataatgtctctgagactgtatataaaattgtgtgatatgtgcatttgtgagggaagcctactcatagcattttgttcattctcaaatggaatcatgaacatctaagttaatagtttgggctcttcccatgcaagtgtatggtagtggggagaaataatgataatagccagtgctctactatgttatttccacagtgtcttaaacactgtactatggaatttacaaatattatctaattaattagtcactctttagtgcccatgttgcagagaaggaaaccagtggctggagaatttatgtgagtcaggatttgaaccaagtcagtctaggtccagagcctgtgctcctagccccttgagtgaacagaggttctgaaatctgctcattcactacccacctgtgacatgtcactgtccaaaaggcagaacttctgctgtcttagagcttctgtaagtatgggtaagagggtaaaaataaggggaggcaggttagagttggggtttccttggataagctctgcattttctttcacttttggaatagaagcaaacaaaatcgtcatccacttggcgttgactgagactcttgtaatacctgaatgtgctcgaaatagacatgaaaaggatgcatatacttggaaggtggaagaaatgctcaggttttcctttaggcctagagaagtagaaggtagtgagcacacaatctggattctgagttcataggtttgaatctttatcctgcatcccactgtctgtttcaccctgggtgaatttcagcacagcacttctctgtgccttagttgccttgtctgtaaagttggactgataataatggtacttacgttactgaattattgtgaggatgaaaagggctgatattcataaagcacttagaagagagcctggtatgtagcaagagctacctgtgctgctattgtgaattttgctattgttattattacaagtgctactgctgctcgttgttttgaaaactaacatttaaaactcttcaaaaagcgaaagtgaatctcaccaccaaatctgtttatttggtttgtggctatgagctaaatgatgttctaaatacactggagagagacacagcccctgcctggggccattgtaatatctgagatgtggaagccctttgtcttattaagctcacgtatgaaatcctagcatggggccagtcactgaaagccctggaagcaggcttaaattcttgttaaaagaatttaacaagacactgtctctggtgtcccacatcacatcccctcagctcacccctcattttagccactgctgtggtgggcagtgctgtggcagctcagactcaccttatacatatagtgcctgcctcggggttacttcaattatctttctgcttcaaggcctttttcaacactgactgagtgtgcttagcctgtgtgtaagggcagccccaatgcaaccttcaccaatggagataaagactggtaggtaaattatgcagcccctcatcctccaggtagatgattctagaaagtgttccacatgcttctcagtggctctgtggattctcaggaacccctgacgcctgcaacagaggccttcaaaacacatccattaattgattttgaaccttaattgtatcactctctctgctccttcgctcctgtctcctagaatcacctttcaggtccttgtctcaggctctgatttctggggacccaaagtaagacataaactgctccaaaaccctactgatcaaaccgatgtctttgtgcaaatctactgtaaactccatttgtcctgttccatgctgcctccccagtgcctaccacagcatctggccacccgtaagcattggcaaatgctagctgaatgatggagtccatgagtgaattaataaacatgcttcctggaacttgataatgagaagatcagtagggtactgctcaattgtacttactaaatgtggcaccagcaatgtggtaaaggatgtcaaaatcttccttggagggctcttatatcttgccagattacatctatctttggtcctggcaagtattcaattttcccccaaaatcttgaagagaaaaagttggcaaatttgttgattctctatcttttcaaaaatgtatatattccaaacatataaatgttttataagtcagctacaatcattgatcctgttatgggcccaccccaggtttggacaatagatgagggtgaactatttggtacacacctttcaagagggagcttatggaaagatgcacagttaacattacatcatggggcaatatttgggcacaataagggaagctggtatcagaggcacatcatgttatgtggacattcaattggccacacattttacttgcaaacgtaacaacacaacaggcctcctaggctgacttgagaatgtgggatgctctttcaatgtgtggacacatacccgctttcaatacacaaaggtgatctgcacgacctcttcaaggcaatgggttcgtaatttcatcttttctagaggaaaagacttaaggtttagagcatttaatctgcagaatctgatgaactcaaggtttccagatactgattgagaagaattgatgttactatgtagcctgaaaagataaaatgcatacactagagcttcactgccagaacaattagtggaaactgtaaactcatgaataatcttagctgacttttgactcaatcagaacacaagcaaaattcaccaatccaaattatggagttcctgagcaagtctgcctcctcttggtcactgaaaaggagggggaggtctgtatagataaactttaaaaagagaatgagtcttgtttaatgactaataataaaacgttaaggtcattggcaatgtgtgagagagagaaaatggacaaagggcggaatattttaattaaactacctaaaagagactaaagtgaacagcactaatgactcaaccttgctgccagtaaagcttttgtctaatatcttgctagctttcaagctgtttttggttataatgttgtaatgttgtttggttataatgttgtataatacattgagtaggtcttgaagattttggctaatgggtttgggtgaaacatggcacggctgctgctgttgtggacaaaggtgacagtgatcatgatggtagtggtggtagtgatggtagcagtggatgatagtggtggtggtggtgtgatgatggtcgtggtggtgatgctgatgacagtggtggtggtggtgtgatgatggtggtggtggtggtgtgatgatggtggtggtggtgatgctgatggcagtggtggtggtggcggtggtgatgatggtagcggtggtgatgctgatggcagtggtgatggtggtggtggtgatgctgatggcagtggtggtggtggtggtgatggtggtggtgatgctgatagcagtggtggtggtggttgtggtgatgattatggtggtggtgatgctgatggcagtggtggtggtggttgtggtgatgcttatggcactggtagtggtggtgatgatgctaatggaagtggtgatggtggtggtgatgatgatggtattggtaataataatgataactagtgtttattatggttcggaagctctacctctccctgagtcctcataaagagtcactgatgtagggtaggtatcattattatcataattgctattcaggttttaaaactgaaagaacaagcttataggggtcacaccattaatgatcagtggagccaagactcagactcaggcaggctttctccagaggctacacacttaactccatgtagtctttatactaatctaacatcttgcatcccattttaaactcatcatgattagaggccatccaaattcagttctaagcaagaccatacatcccgctgctaagggactttagagtgtgataaataggaaattgttcacagatcctgaggttaatggctatgaggcaggactccaaccacaactttattagccaggcaacaatttcattaagtagacaagtaactcacaaggggactatgaacaagctgatgttgtgttttaaaggtcaaaaactgatttcctgtagatttaactaaggcaagaataaggtgtgattttaaatcagaagctttatttgtagttagagcagacttccccaccaaaacatgcagaactgttgcacctgattgtctgccaaattcttatgattggtcctctctgctcttctccccacctgatgcaatgtggatatgctctgtggagaggaaatatttggtacttaaagcaggactctgggaatcatttagccatcagcaactaagtccttatgtctcactgggattccaatttttctcttattactcaggctcagcgagttaactccaaactgagtgcttccaggaaacaaagaagaaagagagaaaaggaagcctttactcaaaactgatttctagaacaaggtagtgctcctagatgaaatgaaaatttcagcttttatcctctgtcatttaaactggactagacgtaaaattacctcagtaggtcatttctctaaataaaaatcccaacttctacaaatgatattatacaaagtgacaagctagtctaaacatttcataggggctccccatttgtcaggagttgggctaagtacttgactggtgttgtcccatttaatactcatgacaaatctaagggcgagtggggcaggagggggtttgttgtcttctgtctggtacagataagttagccagaaatcagagaggttaagcagtttgcctaacatcagacagctggtaagtggtaaagccaggatgtaaaccttgtgactgtcttttctgttctccgctgctacttgtggttcgaattagaatagaagccacacaagttgaaggaatgctacacccaatcccagcatttaaaaagagctgtattgtataaaggtgagaagtacactttttggttacacatctgttggatgaactactgcaagatactcaatctcttcaagctccagttttctcatctgttaaatggggatcatcattactacctcacaggtttcttgtgtaggttaagggagaaaacatttccaaggtgtctttcataagcatccctttccattttattctgagaccaatgccttatgtcttggacctaggcaagatgctggttccataacatgataattgttcttcaaagcatggataattatacgttacatattataacatattatgtatatattttttccttgatggaaaattttcaattttaaaattcaaaagaccttgtgaaagatctcctggtgtgtctcaataatagtctttctcatctctgtaatacagtgtttgacatactgggttccatgggaatcgtaaccacatggcctgaaagaaaaaagttccttcttgaagtaagtttgagaaatatagcagacttgttttccttgttcctttccttgttattttcttattcattgaagactctcatacatgttagctcattaaaggctctgataagtcctgcaatgtagaagcctatatgtgtctttgactataaaacactaattttcacacttctttgagcaaaattttatacacaggtttcagtttggaaactggcacaaagccttaaaggtttttattttatttaatattaattaattaacttctcatgacaaccctgccaggaaaaccgggcaggcattgccctggaatgaagagcccaaagggtatccgtgaaggtaaagaattagtggacagcattgcagccattcatttaagaagctagggctggaagaaaactacctaaaattattttttgaattactttttaacataacccattaactttttaattatttaattccaagaattttaggcactagagcagtttgctgcggacatttggggcagtggagcctttgggtaaaaggcaaatgtggttctttctccaagatacagctctgaccctttcatttatttccatttttgctgctaccacactcaaccaaacctcccaggcttccacagcagtctcccaattagtttcctgtttctcatctaattccattgaataccatttctccacccagtaatcaaattactctccacagcacagcactgtgctccctttcttacaaccttctaaaagcttctcttttcttagaataaaatgccaagtttgtgccactgcctacaaagccctttctgtctggttcttttccacttctccaacttttttctcatcttacgttcccctcctgctacattccagttacatttcccttcctcgagaacatcagactattttctgcctcaggacctttgcacctctggatccatctgcctgaaagcctcccttctcaccagcagtttgtaggaatggctccttcccatcctggacacctttgctcaaatattacctttccgttagctacctccctgtcctccctggctagagtcttcttatccttttctagctcattgcactgtctctttccttgttattttcttgttcattcattggtgggtgtgtctgtggtctgcctccccagtgtcaaagacaagctccacgaaaacagggagctttttcgacttcaccatttcatccttagtaactggataatgcatggcatatagtgggctcttattaaatattttaggaaataagcacataaggaatgagtgaattggtgagttatgttgtcccagagagattgcctgcaccatatataactagtcatgcatgtgacctttgaaaccatagctagtaatggctattttttgcacttatcagtgactctattataattcctctcagatcccatattttcccatgatctgggtaacgtgtaataccctcttgccataatcatctctgaacacacagacacacgcacacgcacgcacacacacacataagaggagagctggtctctaaggtgctgtcagagctgtttaggctggccaattagttggcttttgttctccccagagggaagaagagcaccgtttaattaccttcaagtattacccttcctgcatccttatttttatttttagactccccactgccatgcttcagctcttcttcaaactgctactgtccttattagtgctgctcccaagtagattaagcaaactttttagctgttgctgtgagctcttacatccacaaagaataagcccagaccttagctactgagcaggcagaggcagatgctctgtgagccctgctgcagaggggctgggctgcatacagccatcagcgttcaaggctcatgccttacaatcactgtagtatcctggctggagttcagcttttagagcccaagagcctcgctgggaatcctggctctgccatttagcagacgtagaatggggtatattgcttagtttctgtgtctcagcttttttacctgtgaaataggaatgatcatagaaactccctattttttaaccttttttttttattattatgctttaagttctgggatacatgtacatgcaggtttgttacataggtatacacgtgccatggtggtttgctgcactcatcaacccgtcatctacattaggtatttctcctaatgctatccctcctctagcccctcatcccccggacaggcccaagtgtgtgatgttcctctctctgtgtccatgtgttctcattgttcaccttccacttatgagtgagaacaagtggtgtttggttttctgtttctgtgttagtttgctgagaatgatggtttccagcttcatccatgtccctgcaaaggacatgaactcatcctttttatggctgcatagtattccgtggtgtatatgtaccacattttctttatccagtatatcattgacggacatttgggttggttccaagtctttgctattgtgaacagtgctgcaataaacatatgtgtgcatgtgtctttatagtagaatgatttctaatcctttgagtatacccagtaatgggattgctgggtcaaatggtatttctggttctagatccttgaggaatcaccacactgtcttccacaatggttgaactaatttacactcccaccaacagagtaaagtgttcctatttctccacatcctctccagcatctgttgtttcctatttcttaatgatcaccattctaactggcgtgagatggtatctcactgtggttttgatttacatttctcttatgaccagtgatgatgagctttttttcatatatttgttggtggcataaatgtcttcttttgagaagtgtctgttcatattctttgcccactttttgatggggtcatttgtttttttcttgtaaatttgtttaagttctttgtagattctggatattagccctttttctgatggatagattagaaaacttttctcccattctgtaggtcacctgttcatgctgatgataatttattttgctgtgcaaagctctttagtttaattagatcccatttgtcaattttggcttttgttgccattgcttttggtgttttagtctttgctcatgcctatgtcctgaatggtattgcctaggttttctgctagggtttttatagttttaggtctcatgtgtaagcctttaatccatcttgagttaatttttgtacaaggtgtaaggaaggggtccagtttcagttttctgcatatggctagccacttttcccaacaccatttatgaaacagggaatccttcctccttgcttgtttttgtcaggtttgtcaaagatcagatggttgcagatgtatgttgttagttctgaggcctctgttctgttccattggtctatatatctcttttggtaccggtaccatgctgttttggttactgtaaccttacagtatagtttgaagtcaggtagcatgatgcttccagctttgttctttttgcttacaattatcttggctatatgggctcttttttggttccatatgaaatttaaagtagttttttctagttctgtgaagaaagtcaatggtagcttgatgaggatagcattgaatctgtacattactttgggcagtatggccattttcacaatatttattcttctgatccatgaacatggaatgtttttccatttgtttgtgtcctgtcttatttcctcaagcagtggtttgtagttctccttgaagaggtccttcacatcccttgtaagttggattcctaggtattttattctctttttagcaattgtgaatgggagttcactcatgatttggctctctgtttgcctcttattggtgtataggaatgcttttggtttttgcacattgattttgtatccaaaccccaaaggcaaacaaccaagctgccctcactaacaaaagcttactagatattagggagcatggcagtccatggatgccaaagtggcagaggacacagtctttgccctcaaaaaccttagaaacttgctgaggggacataatatccatatgagaaaagggtagttctaaataaagatacaattaattggacagagagttaaagaaagagggactcacaaaagatgaagatatttctgaggtcataatggtcaggactggacccttgaaaagtgtgggagttggactggacctcagagtagagataggattcagctgaaatgacaagtgtgatgacaactggaaaaaaaaaaaaaaaacaatgagaaaaaaaaaacaatgattgattcattggagtcgttggctagagaggaaagccttctagaatggcctgtgcaaaagggaagagtgaatatgcaaagtgggcacaagagtggaagggagattggagatttgatagtgaatggattcaatgttctgaaggtgaacaaggacacagtgagttctgaaaggaaaagaggttaaatcaggagaccaacgctcaagtcacattcaaattcttaataggataagtttctcaaagtactgagtgcgtgtgtgtgtgtgtgtatacatattatatatatacacgtacatatggttgtttctttgccaactgtaattatttaaagatccgtatagctcctttgttagccactgacatttagacaaacaaatttaattttgggttcttgttttcttcaggttgaggaacagctggttcttactgtcagtcagtgtcagtggcctgctggaatctgtccaggatacattttcttatagttagaatatttaagttgggtttagctttaaaaaaagctgacatccagaaagttagactttgctcagtgcttcttctaaaatggccactgtgtcaagtaaacaaatacctatcgactccatgctatttgtctggaaaaattctagatgctggggagatattaaaaggaaatataagagatagggtctctagcctccaggaggttactgtcattgggaaggtaaggacatgaatcagttcccttttctttcttattcaaacaatatgtaagtttctgttgaaactagttttggcttcatttaaaagaaaccccaaataatagtggcttaaataagatagaagttaatttttcttttacgtaacatgatgcttgaacttcaagcactgtctttaggcatgcaaaatttcttagtatgtgatttctatcttctggcttgctttgtgattatgacttattgctcatttttcagccattagtggctagggaggtggtgttccagattggaagaacaaggcagggggagaagcaaaaaggtctcatttcagccaagtaagactcttttaaaaagctttgctgaattacttacattccactggccacacatatctgtcagagagcctggaaaatgcagttttttaactgggcacattgccacctgttagtaaagaggaagggaaaatcgatttcaggtagtcatcaaacaacatctactgtaatacatctccaggtagctagctctggccaaacaaagcctataatttcttctttgacattgtcccaggactcagtggtagggcaggcacatgctttgcatatctgagatcctgcatgtgaatttgggaatttcctgatttccaggcagcatggaaaaagaagcacacactctagagtctacaagacccaggttcaaacccccaggttggctctagcacaatagaattaacttggcaagttgcatagcagctccaagcctctattttcttgcttgtaaaccaccatctcatagggttgctttgaggattaacgaaaatacctagccttgtgcttgtaatacaatagatgcttaagaaatatcagcggtattttttgtatgctcaaagttggaagttgatcctttaaggattaaaccattttggctttccgaatagcagtttatttaaacagctgttactgaatgacaatagccattttttcatttgttttaatttatcaaaatttccctttttcttttacatttaaacaatggtagatatgatgccagatgtatgtttcacacatatttggggggaggtgaatcttatgtgcatataaatgtatttcttttcattaaaaccggggaaattttgctgaagtctaatgaacaagcctaaatttacttacatatgcttaagtagttctcagccagcagagaaaaacagattgaatttcagaaagattgacttgcacatattcttctgattttgactcatagctcatttcaagtatgagggcaaatagaatagttttctttttatcagtcaattaccagtcaaaattcttctgattttgactgatagcctagtttcaagaatgagggcaaactaaggcaacacatgatagacctatatttccttcacactggcagaggtcaggagtcagaattctataagtttaaaccaatataagcaacccgaaaacagaaatgctatataggaggagaaaaggctttcaacaaagcattgtcattagggttcggttaaatatgcatgcatttgaaatatacattgacttaaatgcaaatagtcaggctgaagctctgctgtaaagtaaaggtacacccacaaaaggacagagccttttctggagaccagcagaaatgtggttgtatttatattagtggggacagaaattatgatcgctctggggccgctgcagcctttctgctgacaagttgcatgccactgttccgtagtgactgttctttacctggaacggcttctccatggcaaccccaaccccttcacagggcgcattcgttgcttctctctttttaaaatgaacacattgggaaggaagtggaatatgtgtgtttgagttcctaaatggaaaaagggagggagtaacagacaccagggaaagcgcagaggatttttttttccttttgcttaatttgcatcctacttccatggatatgggtcaaaaagaaatgattaaaattcactttgtgcattggattctctcttccatcagtgtacatcttggagagacatggtttggatcaattaatctgtattgcagttgataccaagttttagcccagtggtttgctgcaatttcaaaggatacttcagtgttctttttacctattcattaaggactgtcagcagccactcagacccaaaggatttggctgagggaaaaatctcagaataatttttcaagaatataagtttttaaaagagaagactgaaagcaccagaatgatttttctattatgtctgaggaatattgttttctaaactctttgctcaagatccagaaataggagtactttatgggaaaaatctctctcctgttgtcatggaataagttaagagactcctctaaacagaaaaacaaagcaaaacaaaaaaacctcaagcattcagtcacttcaaactatttcatatagatgtcctgctttttttttttcttttagttcccaaaggttctattttttgttgttctttcaattttataattaaatgaaagagcaagccttgacaagtgttgacctcccttcaatgttttggctttcttaaataatttatcccattggattatattcagaaaatgagagtttgactttaagctgagaaagtatgttctaaattgcagcatacctgtgagtaacagcagcagtaagaagtgggaccgtgcaatactgcatgatagaaagttctagaaacttgataggttcctggagtacagaaaacacaaatgaaactaagactagtaaatgtatagatgcagaggttttcccactctgaaatcttacctctaggtttgagtgaagtagaaacagataaaaggaaagattcctatcacacaagtcattgccttcatatggacgtcctttgaacctgtggttgtgttggtcagctgtggccagaaagtgaaccataaacagtaaatcacaagaggcctgtaaggaaaggcccagataggtcatcttcacgtctggctggcacttaaacttggccttttcccataaaaactgttgagagaaaaatagcaatgttatgctagtagccctaaagcacgaaagatgtccaaatccatgccttgctactccacagttacctttatgaaaagtattttcttatagccaaatatcccaattctttgttaccacacatgactaatcttcgctactatttaaaaaaaaaaaaaagtggattcaatgagtagatatttacttcccgaaaattagggcaaagaatttgaaaatgcctaatggaatatatttgtatatacctaaggtgagaaagcagcccattaggtctcttcctacttaacaatcatcgagagtttcatagtagagacatttgctgctcagtgaatatccatgttttcccccatattcttcagcctctctggagttgagcagagccatgtgacaagaagtggccaagagtagaactgatgtgctatttgtaggctgaagcatttaagagctagtgcaagatcccttcagattttaggtgcctcaccacgagaaacatgttgacatggtgtagcaacaaggcaaaagtcaccaggagcactgcaatgaatacagagctctaggaaagtaacatattgtacatcaggttttgtggcttatgtttagtcaaagattctgggattgtctgttaccacagcacagcttcttctatcctaataaacacgaaatgtttgttatcaaggctgaatttctttagccattttgtttagtttatgtaaaaggtggtggagcaatttttaaaactgtgagctttggaattaagcagagatggattagaatcctaactccaccacttatgagctgatggaacatgagacaagttatttactatcttggcctctgtttcctcatgtataagatggaaactccgtctacatgagcagtttatataaaataactagtataaagcacttagcacagaactgagcacatggtgtgtattcagtaatactggaagttgcccttgctgtttgctactcttgatagttggttttcataacagtgaggttgcctttagtaagggactaaatcattacaagtcttttcagggtagagttaggatatgtttgacattactggaagttgccaggagtagtgaaactgaggctctatgggcctctgtcaaagggagaaactaagaatgaaccagcatatcgacagttcctctgctttgttaattactgcccttgagtgtgaccatgtagaaacaggcagattgtttttgtcctatattttagatgtgcattgatgtgcctttggaattctggaaacaccaacatactctaattaagaaaattccattaggaaatgaatttctactgcattgttatatccatcattatatacataatatttatttatgttatctcttgcaaacattgacataccgaatatcaggtcaattaactttagaaagtaattgtgtatttaaatagcagtaagaggagaaatacacaccactggaagttagagttgggaataggttccgtagagtgaacactgtttcaataatatgtaggaatgaataattccccacctaacaccaatgtaataatgtactgtaagcattgcttttctctgtataatttcccaagaattcaatggaaaacaagtaacattatggggaaatattgattcactttgggcacagtgggtcttgttataataaagacagagtctgtggccatttctttccttattctcttctttaaaaaaagaagtaaatatatggaattgctaattataattgggacacttagattgcttccttttatagaatgaactaggagatttcttgggcctcagcaattttttcgtgacttgaataccctaagggcatgaaaaagttaagatcatgtaattatgccagctttagtttttgcattttgattaagccttgagtttgttacaggaatcccaagcaatcaataacaagcctcatcttacttatctgaactcatctcctgctctatttcaacccatgtcaatgtgggaaactgagaatacagtggttaagagtacaagttgtttattattggctggctctatggcttactagctgtatgtgatattgggtaatgtcaaagaacctgttttgttatcgacaaaatggagataataatagtacctcatggagtggttgttaagactaaatgaaatactggagtgagactctaaatatgtcaataaatagtagatgtcacccaagttggctttcctgtggttcgttgtgctcagtttcactcttgcatctcaaactgcagtgaagaatacatagtgggttaattgaggtggcctcagttaatatgaggttttagcctgtcatatcatctattcacagcctatgtgggaggctaatttggtgacaacagcacttgaggttggttatcaaagttgattcagaaaatacagcaggctttggggccgatgcctttcttcacttactgcatataaaggtgatctgctcccaaaactccgaaggaaggagcttgggcatttttcagaggtggctgagtatgatgctctcttactagaatctgaaaacaaacctcctcttctggaaagattaagctactgcattttccaatgaggaatcatacgttttcctcctcagtcatcttggatgatatcctctacatttggactatacatttctaaaagaggaagtgcatgtattaccaactcttctcccactgcaaacattttttgagtgcctaccctgcatgagtcctgggctgaacactttcctgccacttacttgacttccaactttgatcaagttcctaaacttcttgtgccaccatctgtaaaatgaaggcaatgatggctacctcatggagttgggtatgagaattcagtgcattaaagcacataaagcactaagactaggacacattgaaggtactcagtggcaatagtcagtattaaacttatctctaatttatagaagagcaaatggtctcatgggagttgaataatttgcccagggctttagagcccactatacctaccttcaaaatcttggcatttagcccctttactgccctgctgcttcctatcattcactctatacaactaggaatcccaggtgctctgctgtctttaaaaccatgtataatttgttaaagtgacttcaatgagcttaaaaagaaacataccaaacctgagttagagaatgacatggcagaaattttctagaatgaatacaaatttctgcttgcctatgaggttgtcagactgaatttatacttaaagtactgtacctaagctagtctccccttctggcattaataacctcagctctttggagtctaagaataaccaaacgggtgccacgggtcaatggtgggcagcagcttgtgagaatctacttttctcatgtagccaaactgctgcacaagaaataagcaacatttatgtggcccctatgtctaaggtggacacttctttaatgagatgtatatacctcacaagaatctcctttcagcccagctatacataatatactcacagttccaggccttgttcacctcaattccataatcatcctcattatatgacaggagagaaagaagtagacaaaccctttattaagagagagaactcaggtcgtcagcaagtgcagtggatgcttctgtttttgtctaactgacttctgtctctccttttattgataactcctctgcccttacaatctacccagttctggtgggatgcccactgcccaactagacacatgacctaggcctgatcaaatcagactaaatcctaatacctataccagagttattgagaaagataagttttggtctgctggccttgacagtgaaaggatgtaggcttggagctcctcagggccactgcttcagggaaccttgctgacagtgaagccaacacagaagaaagcaaggccaaacattgaaagagatagagtcctgattcttccttttgaacaattggataccacctggcttgaagctttccactgcgcttctcatctctgataagggttgacaggtgtcttcctatttattccttaaggcagctttggttaacttcagtcatctgccactgaaaagaaccagttcagcaaattttatccccattctaagatgttctccctcccaggtcacttttagtttcttgtgagcacttggcatgttgtgaatctccatcagtaatctctgaagaatctgaagttaccaaactccttgacttttggcttctgcccttttacctctagcttagcggagttacctagatcccacatggcatattggggaaagataaaaaagaagagagattatctccagggtagttttgttccatacatgaggaaatgctaataactaatgaaaaaaattgctttgtttctcattcaagcttctctaaatatccaaaggaaaatgttaatataaatctctattgcatatgggaaaagtgaaacttggagaagttaaagtgcccaagatcacacagttagtagctggtataactaggattcaaaaccatgcgtcttatttgcatgtgatggaaaggcaagctgggaacctgtaaccttctgcattaaaggacgcctttcatccaaaccccctgtgctttagtgtggcgcccagagctcctccttcaattctgtttccatggtgcactgtgcatgtgcagtccttgaacgttcttgcatttgctgggggtgggaagcctttctccaggtctcagcttcagatgctgcccacccagccatctgtggcaacagatttgtgtgttatcaattaaagtctaaaggaagttggcaaaacctcctactctaacagggtgggctaaagaagttcctgttaaaacagaaatggattgtgtctatgatagtggtagttggtagctttccaagagcactttaaatacaccccatgccttgaattgctcagctctgaatctctttaagatattcctctcagaggcagctcatttccatggagcagaccggtgcataattaaacagggttgcccttctggaaagcaaagcaacattcacaatttggagaatctgctcctgtgattttcactttgtgactcacgtgggaaatcgttattttttttttttagtgtacaaaatcttcatatatataacatgtcgtgccccacttacagtcacaaaaccttcttggtttcgattgctctggaagactctttaagatgcctcacctagggaactccaaaatatcaagtacacaaaatggcctttaagttcaagacagaaaatctcaagtacatattccttatttagtgaaaatccatcttgctatttttacataactagatgacttaaagttttagatagagaaatataaaacattttaaatacctactatgtgctattccctgtggtaggtcctggaagaatagagattaaccatatatagtttctaccctcatggcacttactgtctaatagctaaatagggatttatgacagtctggccacacatacaaaaaatgggtactacattggcttatgaagaattatgattctgaatcataagaaatttagtcccattacaggataggcccttgtattcttaaacatcacattatccatccttctactaacactctgacagcaatatacaaagcacaatggtctccctttctctcttttgtaaaatttatcaacttcagcatatttactttggggccagataattccttgtcgtggggactgttgtgtccattgtagggttcttagcatcatacttggcctcaacctaccagatgccagttatgacatccccagttatgacaaccagaagagtcttcggacatggccaagtgttccttgggtggggaagagagtgggaaaaatcacccctggttgagagccactgagccaaaccaagagtaacagtagttgttttacagcttccctaaaacagaatgaatcttgttttaaattaatagagaaagatgggtcattcctggagacaaaggaatgcactaaatgacctcctaagatccctgccaatcctagaattccagggtacttttacccataacctagtttggttcctctgtgtccctgtccccgtggaccctcatgactgtgcctgacaggcagctgcatatccaacatgctctttatgtcagcaggaaccctggaggagtcttttttttttttctttttttaagttctttttgtttttgagaaaacttggcagaaacattctttttgaaagaggaaaaaaagaaaaccctaaaaacaaatttaagggccgtgggaaaataactttctgtgctcctaggtaccaggaccgaccatttgttagtatcgagcatctgctaaagtgtgaaaaattcttggaaggcattttctaaattttgttattgttgttttatccatttatttctatgagccctttcctttgctgtatgttgcctgtccatgttgggctggccaactgaggtatgcactgtcctttattttgaagaacatactatttatctgatggttgggaaggtggccgtactgaagtataaggagcccagcatttgaatgttttaagacctgacttttaatcttatgaccatcacttcctgactttgagatctcaggacttctgtgctttaattcgtacttaaaaacgtggatggtaaaactctccactgaacagctgtggggacaaaacaagatggtagctatttgtagatttcaaaattgctatgaaaattatttgttaatatgattggacattgtaatcatgtagcaaatgtttgtttccccattggctacttatgtagggtttatttaaaattaggcaaaactaagaatatgtttcctggccacaccttttatatcaatctctcttcaaatgtgatccctggactcttctttaatttcccacttcagtagtccgtcttacaatttttttaacctagtttttctgtagtaaaagtgcagttttcagagttcaacttagggtcaaatcccagcttctgcttcttttaactccatgctctttgacttttaacctgagcacaatgtcttttacatttacattccatttcctcatcaaaaaattggagataataataggtcatatcttagagagttgttgtgatgataatataaaataatgactataaagtggcatcaagatgcctaggcccggagaccggccgtgaagatgccagtggcggtgatggcagaaagcgcctttagtttcaaaaagttgctggatcagtgcgagaaccaggagctcgaggcccctggaggaattgctacacccccagtgtatggtcagcgtctagctttatgtttgctccgtaatgacatgaataatgcaagatatctttggaaaagaataccacctgctacaaaatctgcaaattctgaacttgggggaatttggtcagtaggacgaagagtctggcagagagatttccctgggatctatacaaccatcaacgctcatcagtggtctgagacagtccagccaattatggaagcacttagagatgcaacaaggagacgcacctttgccctggtctctcaagcatatacttcaatcatcactgatgattttgcagcctttgttggacttcctatagaagaggctgtgaaaggcttattagaacaaggatggcaagttgattccaccacaagaatggttctgcccagaaagccagttgcaggggccctggatgtttcctttaacaagtttattcccttatcagagcctgctccacttcccccaatacccaatgaacagcagttagccagactgacggattatgtggctttccttgaagactgacttatcactctgagttcaagattcatcttcagaatcctgtatactgacaaatatagaaatgtaaagtttgtattttcaatttattggatggcttaagcacctcagcattccttactatgtgataaaatacatatagaataaaaagaaaaaagatgcctaggccctatgaagtacacaaaaagtattaacttgtactgataaacttgaattcataaagctcctggacaaaattgacgtaaaaagccttcatctttcaaagggtatagcctccattttgaaacaatttctttggtttacacaacccgggggacatggtccacctcatgttctctatcactgccctccctgtccctcaagcttgtgcaaccacaaccctggattttatcagttttttccatagaatgttaaagattttctacagaaggaacctctgttgatacattggtagaagtttcctcaaagtcagaatgatggaactttggaagagcttgagaaaaactggggtattagagcactgcttcttaaactttaacatgcgtatgactgccttggaatcctgtcaaaatgcagattctggttgagtgggtctaagatgggggaccctgagattctgccattcctaacaagctcccaggggttctgttgaggctggcgtagggaccacactttgtgtagcaaggtgtagatgaggaagtttgtctttatctcatctatctttagatgccgtctttctccttaagaggtgcctttgactcttgataaagcttagatcccaccaaaactttcctcctcctctcccagcgttcagaggctagtgtggaacaagaatctcaggagatgttcaacacccaaaggactgtggaataaaaataagtttgccaaacaccatgaaccatagttccccatcttggggacccacataatgcatggatgtattaaaggctctgaaaagtcctgctattttttaaaaaacatgtttcttatggtttactctagaattccccttaagtaatctacaaatatcttaagactagattagaatctcatgggtggaacccagatttcagtagttctttaactcttcctgggtgatcccaatttataactgaggttgagaggtctgccagggtaagcataggaaattctaacagaatacacttggggaaaatcctacagctaaaatagctcatctaataacattgtttattagatgctaaaggtgataatttctgaagtggtaagcctacctttatacaatagatttcttatttgaaaagacttaaatggcttaaatcaggctggaaatttggagatgctggagctgatggatttagtggaaagagagaacaaggactttaaaatacctcttgtgtgtgtatatatatatgtgtgtgtgtgtgtgtgtgtatatatatatatatatattctatatataatgatgtgttggcatcttaaaaagaaacaaaaactttctagctggggagagactgcctgtcctagagctaattggttcttagtggactcagccaggagcatacccttgttatggaaactaagtaatcctgagccatacctccttaacctggcccatatacccagaaggcaacattcctctgctttaaccactccagggccaggtatcaggcaactagggaccactcttatagtttagagccagccaaattatccaaaatagttgatcttcaatagtttacccgcccctgcctctcccaagaaaactccaaaaaaggctgcaaaatatccccccctcccaactttctgctcctgcctctgcctcttgtccagcctagtgtctctcccatgtggcctcatgcaacgtgccatgccttcgatctctagggccacttaatatgttaagctcgctttcctgagcctctcctgtctcctctagtggccccacctgattgaccatcacataaaagaatatgaaacactcctcaaaaccacccatggcattgaatgcatgtctctatctgtgtctaccaccggctccaaccagagacaattttctgaaacacttgaaagatttgagggcaaaacattttttttgtagctctattgaacgtgaattccatctctggctctttcttccgcttaatgataggctttgagcaaagacattgaacttctctagatgtcctgatccttgtgtataaaacagggctcacacctgccctgcctacctttcagacttattgtaagcattaaatgtggcagagaaaacacacttggtaaaatgatgtgccaaacacatataaaatataacattattgttgtgagagaaaaatgttgcctcaatttctgagaaataaatcaattatttggtgcctttgattatatgctacagaaatttgagaaaaagcaggactctgcttctgccaatgttcttgtctttgacctctgctcagagtctcagtgctaattggttctgtgtagaagaggcaggagaaactttgttacctagtttgtctaattaatagccacagatcaatttgcttgtcattttttctctcatagattacttgttgttttttgactaatgggtcctatctgaagatggctacatattgtgccacaaatttgtcctacctctggtaaacatatgaccttttgaactatttgacgtagcatagcagtctgtattttgcaagaagccttatgtatttaacctccttctctcatatcattttgcatgaatgtattctgcctgcagaggcccttataaatgggcaataagctttgacatgtgttcagatcagtttggctcagaaagtttattttaaatttactatacattttcattgtcttgtcttccaaaattccagtgatggtaattgtaacagttcacaccaggcccttgatctcatctgtgcaatgacaggtgtttgagaaagttcgttctgggaatgtcagagagacttcagaaaagcgtttggcctgtgtctgtgtagcttctcagcgctgtctttgtcacattccgtgctgtgttcagccttcctcccaactccggcagctttccaaagcagcctcctgattcatcctcatcaagcagcagagaagcccaggtgcagctctgctcagccttctttggggaggcagagctaagggttatccccccaaggcacaggacatccctttatacagggattttttatcaagattaaatttattcaagtacaagatgctttgtaaaaatccagtccccaataatatctacatcactctgaaatggaatatagaataccaaaatgaatttctttttcaaagaagtgataagctgccttggatgtatacataaaagaaatttttaaatgattagcaatattattttattctgcctattttagatacaactgctgctattattatgtctactactgactgtaatactgagtgtacctggaagtaagttaagctgtttgcacacattatctcattccatcctcctgatgaccatatgtagtaagcaacgttttttacccccaacttatggttaagaaaactgaagcttggagatattaatagttaaattttccctaagtgcttacttggggtgagccattacactagtcactttacctgtatgaggtcaattaatcttaattaactaaagtaaatgtagaaactctgttagtcactaaggctatcccatttcacagataaataaattgaaatgaaggcacaaggtctatcttagtctattttgtgttgctatacaggaatacctgagactgggtaatttataaagaaaaaaagcttatttggctcacagttctgcagaatgtacaagaagcatggcaccaacatctgcttctgatgagggtctcaaggagcttccactcatggctgaagacaaaggggatccagtgtgtggagacagagatcccatggcaagagaggaagtaagagagaggggtgtcaggctgtagtttacagccagctgttgtgggaatgaatagagcaagaactcattcattacaacaaggatggtaccaagcctgccaggagggatttgtccccatgacccaaacacctcggattagactccacctccagctttgggataaaatttcaacatgatatttgggaggacaaacttcaaaactttagcagagtcttaagaaacttacctcaggattctagatttaggaagcaatgtcaaaagaagacctagcacgtgtgtttctaaaggttgtgtgcaaactctttcttctattgacaaggaaatagaagttagaggcataggagatggagctgggggctgggttgtctgcaatactttcttcctttatcttaaggtccacctccacctgaaaagctgtatttatttcatttgagatactgcataggtaatgaagcaaggtctcttgtgctgagaggcaaatactgtaatcatctgcatgacttgattctttatttcagtaatatgaaaattgtcaaattatggatgaattatggatgctacagatacctgtaatttgctgctgcagttttgtaaacacatgcagctgcctttaattttgttttaccagtcatgtaattcattaacacacacctgcagtttcctaagatacaaagacgaatgaagctggtttgcagttcccactctttgtgtttcctacacttctctgtttaatcaccacactcagaggttgagtaattggttaaaaataaatgcatctcaaggaggagcctggtgattatccttgaagaacatgctcaaattcccacctcagccattgacttaaatcattgttttatcagccaaagcccagggcagtttggaaattaagaaatttgtagaattgattttcattttttgcaactgttatggcaacaaaggcaaatcattaaaaaatggattttggagatagctgttggagactccttaacatgagagccatgactggtactagtgggttcttgctgcttcaccaagaggagtgttaaccaaggcctcatctgagaaatgaggtgttgcaagatggtactggcaggaagtacatgttttaacccttcatttacttctttctttctttcccgcctattgaaattgatgagttaggttatttttgattgcttcctctcctcactgtcatgcctgtaaaaaattttaaaatgtttcttttcagaaaaaaaaattctcatttttgccagcttttaaaaaacaagatcttcagtaaaaccataataagaaataacagtaatagctacttttgttgagcattagccctatggctagcactttattaagagtgttgcacagtcaatttgttgagtcctcaacacaacctaataacattggctttattttcctcaatttatacactagaaactagaaactaaaaaactaagtgacttgctgacatggggcctctatgacttaaactcaggatggccatcctgagtttattcaaactcaggatgttgtatttcacataacaatgccacatagacttatacctcacacagctatcctcttgattccctctacacctttcaccattaacattctcctttgtatagccataactgttacacaagctgcaacatattttgtaatactatgccagttccattgctttactcacttatgtatttaagctattgttatttaatgtacaaaaatgttcagtgtgaaggctaaaattatattgacaatgtcctaagtggctttaggcaagattataaagtaaggcaggcagcttttcttgatattttcctgtcctttgtataccagaacatttattaggctaaatatcttagtttgctttgtgttgctgtaatagaatacaccagacttagtaattcatacagaaaagaaatttcttgctcacagttctggaggctgggaagtccaatatcaaggttccaggcaagggagggcctttgtgctgagtcataccatggtggaaggtggaagggcaaaaaagcttgagaactgagaaaagggaaccaaactcacgattttcatcagcaactgactccagcaataactaacccacacctaagataattaacccccttctgtgataatgacatttattcatttataaggacagatcccttatgatgtaatcaccataatcaacaccgttgcattagggattaagtttccatcacatgaactttggggaacacattcaaactatggaactgaggaatatagcctgcttcccctgttctacaccaaaacttatacattctatgtctcattgctacaaaatcttatatgctactggattctaattagcaatgattagtttatctgagaagctcattcatgtaaatgaattaccaatagacatcatttaatggagttttactacatgataggcactgtggtaaattctttataaacattatcttacaaagccctctatgatggcattatcttcatttataatttagggagttgagggacacaaagattaagaaatttgcccaaagaataattttgtaggccttagaagcaggatttgaaattcatttctatatgacacagagccctgagttctgatctttttgccacagcactgtttctgaaagtgtgtctacctgcatcagaatcacctaggctgtttgttgagaatgctggtttgtggaacgttcaaaagacctgctaagtcagattctttgggtgcagagctcaggaatctgcatttttttttgcagttttcccaaacctcccagacatctatataatttttagtcatgtaaaaagcttatgactttttgacaagttccataagaagtaaacacagtgatagtgctgtaaaaccctggtgcaagtcagtgagcaagacaattttgacagtccaaagtcaaagatgactgaatataccacagaaatctgaccctaatgctgtcagttaaattcagtcccatgatatgaagacttgatgcttttagagaaacccaaatcaaagtagctgaagctcaaaaggccattaattgctcttttaaaatacagctagatctaggtgctcaaccataatcatcaccaatacttttctcttcatgttttggttcacctctcctctgtgttggctttattcttaagtagcacttccaaagtggtgatgaggtggcccccaccatctccaggcttatattctgccaggtttaaattcccaatggaaagagttcatctttcagtgtaattccttgagaagtcctagggacttgggcctgggtaactcctctccgaaccaagcagaaatcagcagggtggcatgccctgggcaaacttgaatcttttccaaagtcctgaaactagagagaggagggaatggagagtgggaccagctgcttataagtcacatgaactgagagtaagggaggcttggtccccaaagggaagttgagtcttaatagtacaaggagagggaatggatgttgggcagacaaatcaatgaatgtccttctcactcatgaatggacaaaatgagttactctttttgctcatagtcaagctatcattttcccctaggtgactattggtagcataattttctcagcaaatatttttaaatgatacaaaatctaacacgatccagtgctcaaccaggtgtgtctatatatagatccaatagcaaactattcacatcagacccaattagtggagttaataaaatttatttcccagatgcttcaaatcactgaaatgaataaagttgtttatgacaggtcacaggacactttcaaggaccagttaaaaagtgctgcagtttggagagagctctgaggtcatgattagaagctgagaaggtggtagatgagagagtggaaagaataggaattttgctgggaaagctgaaagatgtgaatagaaatgaggatgtttctgagctgtcatttgcaaagctctcctatggctttgaaggtctttggaattgagctctcacagactcgttttattttatttgttcatgttttacttattgtaaactgccaggaattagcatcacttgtatttgcagagagaacttcatgggttggttaagattcttgtttctgtctgatgaatccatggtgttctcatggctaagagacagccactccaaccttgacattttccttgagcgagagaaccctgtcatatgactcccctgaattagtcatcagaacaatccatggtaagaaatacttgccttttttcattgctattgcctacgtgttgcttagattgctgcgtgaaaagttcagtttttataataagaaagctatccacaaacttaagtgtgagtttccttatattctgttccccttcaatcactttaattctgttttctaactcccatcctttagggatgatgaaaaatcctatgtcaggccttttattagtaagagtaattaatgctagccagcttaatgaacagcatccaattcttagtggtttaatagcaaattaatttcttagtgttgccattgtctgattgcttatttggcaggtgacttttcatttggtgttcagggatcctggatctgtccatctctttttgccagtattttctaaaacatcctaagataaccctccttcatcctctgcatccagtcagctaataagcaaaaagaaagagcatggcacatcacctgaagggttttagagacctagaaattgtctacatcactttttcccataatccattggccagatctacctacaagatccacctgcaagatcccacctttactgcagggaaaactgataaatgtaatttcccagtgtacctaggcaggaaagtgggtttggtgagcattcagccacctcctgctacaattattactggggcttccttttgcttctagattatagtaaaatctagggaacttagttgcaaagtggagcctctttagcttataatattgcagctggcaatcctcatgttccaaacccctgtttccttgaggcttatgtgtctctcctttcatccccacatgggagtccagagaccaggtccgccttttttagagaagccatatagccatctgctcagtgttcttgctaatactctaggctttgccagggaatacatgtgactttccctgttctgggggccctgccttgggggtagttctctccctcagcttgaacttttgtcattttcttaagtacacacgcaccccacacacttctattctccccagtgcccttgggacattgtttaacttctattttctgccccccaccaaacataatggaggaagagagcatagaaaggcttggctaccattctgcaatgaagacagggaaaaagaccaagagaaaaatacaaatcataattttaaaattttgccataaataaaagttgagatgcattgattatattgattacttatatcggggttatgccttatcaacaacccagttaatcaacaaaccagttacgtcaggcccatgccttattaacaaaccaatcctatgagttaagtaacatttctcccattttaagatgtggaaactgagacttgaataagttgtattactcatctctgggcatactcctcattaggtggcattcatgacaaggacccacgtacagcagactccaaatcctgggtcagtagccactacatcactctgcagtgcctgatcagtggggaagctataactatgacattctcagtagaaggcttgccaacccccagaactgtgcagccttagcagacagggatagcacattcgcatttaccaagcctttaccttatgccaggtattacgttagtcagtttgtagattctgtcttgcttactttttccagcattaatatcatccctaacttacagatgagggtatggaagttgagtgaggatatcgcctgccccgttatttcagatggagccatgtctcaaaccctaatccctgtgactccttagttcacactctattccactctcttatgccttgtagaagtcctgtcactgtgtggcccaaggggaagtgattgtcccttgtgatctatgagcgtcatagccaccccttttaaaagtcttgggccacaagttggaaattaacaaatcattccatccataaagggaaaatggaaagtgcttcacatgatacgtgaagattgagtatgatccaaacctaaagaaaatactgatggaaatcttattcataataatttctcttcatttcttgtaaacctccattatatcccagtttcatgaagtaattgcagggtgtcaaacttgaacagcttaaagttatataattaattgcattcagcttcagttacaattactaattgatccaagcctgccagcatagcacctggcagcagtcaggaacacaacagcggttgcaggcaggtggttgcaataattaggttactactttttttcccccttcaagtaccaggtggtccaaaccccagggtcaagcagactgtatttggcccaagggtaccgtttctgacatctgagttcttttgaagaaactaagtgcagtggcagaatatactagcccggaacatggtaaaaaagcacaagcaccaaactgggcttactgcagcagaatcagggaagaggatccagcatcccaaataaggtctggagaaagggacagactcttaaaccagcagtcaggatatttctgagattttggctttcaggctagcccttctaactaggtatctgggaaataagaaggaatgaggatccaaaagcaggcatgcaatctgagtttgtaagcaacgctgcctggtagtcataagcatcagactggaaatcaggtagatgttcttgtttgtctgcttggttgttttattttctcctgggtctgcttcttattaagtgagattttaggcaaactacatgactttgctaggcctcagtttcctcatctgcaaaataggaacagatactgtggctgctgtgcccactaaatgagtaaatgcataaacattgctcagcacatatctgttgggcaataaaatgatccattaatgttaacctgttttatctgtattgtatctagaagggaaaacagttcagtgacctacattttgaattgggtatttaacaatgaatataacttcaaaatgatgaacagcatcattttcatctttataatattaataataactataatttactgagtatgtgttctgtgccagggaaaaaaataataagtcttgtactagctttaattaatgccatccttatctttaatgttgatattaatatccctattttatagatgaaaaactgaggcacaaagaggttatgttacttctctgagaggaaatgaggaagatgagttagaactcagatatcctaattctgtcgccaataaccactgtgctttactgcctttataagccctggggaaaatgttctcaggttctttctgacaatattaacaaacttttatattttaatgccagattatcctagcccagctcttgtattttagttcagattgacttaaacaatagccatgatatagaaaacatgtttggagcatattcagaaagctgggaaagctattattattatttgttacatttattttttatttcattgcttttctctatttttgtttgctgtctttgtgcttacaacatgctcttgagcatcctgtagaaattcatgctgaggtcaatgttaagtggcaggtaggaaacttttataggttcatgatcttaaatcagaaagcagaacattgccaagagatattaaaaataattgcaatgaagatgatcacagctctatcaagaacatctgataagtaagcttgttatttactggaaactcatttctcccaactgctgtaaagaggaggagaaaaagccttgcctttcttggaaggcacaggagcaaacaggaaaaaaaatacagttttatttttaaacagttttgagtcttttctggagatgttttctaatcaatagaaaagactaagaaatcttatggtctcatctcccaggttttatgtttcccatttatttaaccaagataataaaaactcatatgtggtctctttagtcatttccaaatagggctggcttcttcagtttatctccaaatagggctggcttcttcagtttatctccaaatagggctggcttcttcagtttatctccaaatagctctggctacaaatttcatttcagaactgttgttagcattatcaactgctaggtggatagacagatatcacctttggctttattattaacaaaaataagtctacttggtttgaaggatttgagttataataatgaaaaactgtgtcttgttttttggcttatgaggaaaagctgtgaggtctggccaactttcacatttgagtccctttactctcaatctattccctcagtcttggatttaacaagttccagagatcaatagctttctcttagaatgagcggaaattaaaatctgtgatgaggcttcacccaacccccttacaaaatctgcccctggaaagcaacccaaatattgaggcccaatccaatggctctgcttgccttttattcgcctgacagtcccagattgagaggaaatggccttcagattttggcaaatcttttacactggcattcatattgctgaaatttctcagccacatttccgattcagaagtgcctccccactctgtgatgtgggtccaggcagctagcttcccagcaagctttgagaatccctactttcttatccataactctgcaagcaatgaatgtgtgcagcatacggtatagtgaaagggcattgcaggtaggggctggtttcaaattcaacttgtaaggtgtaagttgtatgacttgctcatgaagctgatatacatttctctttattgaatcttgatgacatagatactagatacattgtggccatttttcgtgtcagcttggagatggctatgaggtctcatcaatcaaaaagtcttacccagtcaagttttcagggttaggaaacattagtctttattcagctgaatataaggtacagtcattggctagaatagagggccatgacctgtgcagaatacatcattaaatgctagagttgtactctgagatgagaaggcctcactttgtgatgaccttaacattttttggatcctttgccatttgcatattacttctttcttttacaaatatatgcccttgatttcatgtaatttaattgaaataaatgcaagctacagcatcatatatgtattttgtgatggagggcattttgcatatactgaaataaagagaaattcttgtagtttgaatggggaatatctgcacctcatatcaaagttagacaaagaagatggtgactgaaggaagaaatgaaatcccaaatgctggggaagggcatggcttttgttcaatctcctgttcattcaatctgcaattactgaatgccaaccacattacaagcattgttcaatttgctgggggctgagatgagaagggtatgaattttagtttcgaagagctcacagtcttgtcttgagaaagaaaggtttgacagacagcaggaaagccatgtgacttgaaagaacatggggaggactggatagaagatgatagcacaccacctgcaggggtgaggagccccattctgagatcaggagagctgattcaaatcccctcatcgcctgattagcagtgaaatcctatgcaaaatgcctgagttgtttctttatgtgaaaatgaggcagctggaccatgagcctattaaaattccgcaaattgtgctccttgaaaaaaatagttcttcgtggtattaacgggagactttgagaggcaaaacatgccagaacgtctgtggtcaaacaatttaagaaattattagcaacactttctgtaattgagtatccccatttttctaagaaaagagaatgaattactattttttaaattattttttcttcttttctcttctccacttccccctgctccccccttcctacttagttttttagagatgcaaataatagccttttacttcctcttcactggacacttcctacagggcaaattccagaacagaactctcaaccaccaggaggttgcctcaagagataacagttgacttacaacctaaagtatgcccactacaaactttctcccacctggaaagtttttggccaccattaaaacctatttatgcccacgaagacaccagctcagctgctcagtagataaggcaccaaactagcacatggaccacccccacctgctcatttctatcactatatagtcaccccttttaaaagcatcctctttctgctgcaaaatcgaagcagtcttcttaagggaagaaggctgtacttcttccccttagctagctttggaataaaaagtcacttttctttataccagacctggctcttgttaattggactctgcaagcatcaagtgaccaaacctgtgtttagattacatttcctctaataggcagactgaataagtgtatagtagaaatggaaagctcttgggcttctgcaaggtcagtggtatgatctttactttatagtgagggaaactgtgactggaataaatgaagtaacttgccagatagctaagacagctaattgtagggcctcatagagcaggagtaagtgtacattttttataaagggaccaatagtaaatatttaaggttttgttggccatatattctttgttctgttgcagccactcaactctgcaatgtaatatgaaagaagccatagattatattgtaaatgatggacgtggctgtgtttcaataaaactttatttgcagaatccggcagtgactggctttagcaagagggccttagtgtgccaactcttatagtagagcataatgggctttggagtcaaaccgcccagaagataatatccccagatatgtctttttctggctaagtgactctacagaagatatttaatctccctattcatcagtttcacatctataatgtgggcataataatagtatccacctcagagttgtgagaattaagtgtaacatctccaaaacaattataatagcacctagcacttaatcaattcttgtttcattagccatttttggtaatagtcagcaattaatcaatttccctaccgtcacatagttattaaaaagtggggacaggatttccattcagagggtcagggtctggagcctgtgcttttatctgaactcgacctccaatgccctctcagagctggaggagaaagggtttaggtcaggtctggctaaccgcagagcccatgctgccttgccacaactggcctttctgaccatacactcaatggataatggtccacacactcaatgatcacagcgtgtagatttcaagtgggtcaaaatgcaaatacccagggcgttaagtgtgtgggtcactatccatttagatccacatcttaaaagaaatcaggaccatgcctttaattgcttttgtttgaaactcttcataactatatttactatacatatatgtaatgttatgataatactttgatgtcaacacaatctaagttaggaagctacaaaaacaatgtttacctctatcccaaggacataaattttcccatagaaggtataacgctatgatatgctggaccaaaaaaattaggcttatgattagggatactcactatatgtaaatctgtacttaatcctaaattttctagtttggaatttcatctgtgtacttaacctccatttctaccactggatttatgttctattttaagagggtacagtgggggttctcaaagagtagtctccaaactggcagtatcagtgtctcttgaaaatgataagagatgttagaccttgggccccacctcggacctgctcgattagaaactctagggcccagaatttggtgatggaacccagcaatgtaggagctgtgtaaatcattttataatatttctatcacttgtataccaccttacatttttccaaaatacttaaaaatataattcattttcagcttcaaaataatctttaaggtaggcaggatagtaggatggaaataaatgtttgcttatatcattttgctagtgagaaaactagacaagcatagatcttgatagcaaagctaagatttcagactcaaaccccattttgttattattttgagttcatatttttcctcaagctgggccttgtttacttatatttagtcttattggcatggagacttgatcatttctccttgattagtgttccctggtaccttttgggttttaccttcagattcataattattaattttctagaccatgggtcagcaaaactggcccaccaccagtttttgcaaacttttttttgaaacacagccatgctcatttcttttttatcagctgtgagtggctgcttttacactacagcagcagagctgaagagttgcaacagaggttgtagagcctacaggtcacaagttctctactctttggctctttatagaaaacatttgccaattgctggcctagaagcaatagatttctcacataaagcctgataataaatagcagaagagggccattcagtttcctaactttgacttcaggatcaaaggttcctcaactcttctttgcatgtatttctcagtggtctagaccagtggtactcaactttttagcaccagggactggttttgtagaagaaaatttttccacagatggggttgggggatggtttcaggatgaaactgttccacttcagatcatcaggcattagttagattctcataaagagtgtgcagccttgattgctcacatgcacagttcacaatagggttcaggctcctataagaatgtaatgcgcggctgatctgacatgaggcagagctcaggcagtcatgcttacttgcctgccgctcacctccatggaccagtgcctgtctatggcccaggggttggggacccctggtctggaccactctgctcattaagactataattttttctaccataactggtaaaactaagtttactctctctctccttcccctatggctcaatagtgtggactttattttgactattaaagtatctcaattaagtattttctgggagtccattaactgtgtgtttgccagtctgacataataaaattctgaaaacactccaagtgaaatattttaagcccagacaagaggcagaaaagcaaatataatatactcttgcctctctgattatgttatctgaaaaacctaaagtgctttctagtgcactctatgtccagactcagaatgaggaatgacaaaatttttagataaattggtttgtgaaatatttatgtgcactttagtggcatagacaggaggtaatctgttttgtattgaatcagcttgggacagaaaaaaaagcacaatgttaatgagattttttaaaaccacttttaaattcatgttggcaaaagacaaatagtcaagacttttaatttctataaacttaatgactagagaacaaataaagctttattaacttaaataaaagtaagtagcttttctttcaagagcataacaatttatttttctttctacgtaatcttctgaaggactactcttttctacatattaatcatccttttccagtgtgttagtttgattttaactaagtactgacgatggtgaaaaatcacagggtgactccagcttagtacactgggttaagcctgtggtctgggagttagccaacattatttccctataagatatgcaatgtccttgctgtattacctttggccaatacttgctgtctccatttcatccactggttccacccatatgtagacattaaactgattttagtgtctgatgaagttgatgctgcactttgaatgtgttagttattctagaaaagtagagtaaaggctgagtccacccttaagtcaagacttcaaccttcgatttcattgatcttcccaaacgacggtcagatatgtttgtgctcccatagtgttatgatgctcccatagtcttttatacttatttatctctatcatggcataattcaccctggactgaaattactagctgttttgtttgtattcccttttaaactatgacatttttaagggtagaagctggattttgttcattacagtatcctaagtacctggtttgccatcagtactaaataactttctgatggatgaactaattaaagagacttaatttttaactaataaactggaagatctactagaaggatgggaaggagcatgtaagtagaccgtgtaaccagtcaaactctgccagggaacttgctaaggaacacacttccaggacaaaaagaaactaaatcccatctagacttttgcagtttaaactcttaggtctataaattgtgtaatctcttcaaaattttctgagctgatcctatatcccagtcttcccatttgtgcaaaaaccctctttctgctgaccactggcaaaatgctttagcttggattgctgaatgtgttttttaacagatatgctaatctcaggaatgatgcatttcagctctagcatcattaaaataatatcccattgccattctgcagttcactgctgagtcagcacgtttattacaatctctctcttcccaggttcctaatttggccataaaaattcactcagagtagaaacttcacataggtcttgcctctgaatggtattttttcaaacagaatctcaaagtaagctgtttaatgtacatgaactattgtggaattcacacacactcaagtagaattctgaaaagggcctttaaggtgttgtaacttatgctatcacctgaaatactgacacttcatagtggtgtcatcaggcaagttttgaataaatcctttttgtcccccttgggtaattgccctgggtatgttctgtagaatattcccagtttttgtaaactcgacaaattttcatttttgcagaatcttttctttttcattgcattctccctcccattttttatgcacctttgcttttacccagcttttgcctcatgatctcatctaccacatttgttccttttgcaacgtgtgtgtgtgtgtgtgtgtgtgtgtgtgtgggaggtagttacacggggaagttaaaatctagttcttagggttagctctcaagttttcacatatgattacccactttgtggattatctatgatgtatttttcctgcaattctactttcccaatccacttggaatgtaactgaatttattcctttctctcattccaatacacatttagtggctgtataaacacctctgcatatcctctgagatgtatcattttaagaatgtatttcccccaccccaactccctaaaatatatttaaagccaattacttaaatgctgttatgtatatgcctatatttgaagtccatgaatcctcttccttctatgttgtgaatgaacaaagaatagctgttcatacatgaactctttgcacagttgtttaagaaggataaagttcaggccaagggacagcaacccaaaagagaatctgaaaataaatgatagctcagaagtccatgatgttttgtgcatggagaactatcgactgctggaattttagaatctcaccttctatctgatgagtgactctctgtatcaacatctctaacaatgaaaaatgttagtaaatttgcagcaatctctgtggcataaggtgggaactcccaaaaccttttctttcaccagcaaaactgcctaataagcaactcccatgcacacagattctgtcccctcccaattctgtctgaagccctatatttagagaaagatttcttagggttacactttggttttaatttgtctcaggagaaataattgtctaacatagccacccagcttttgaatatgaagtatatagaagcagctaaaataataagcttagataatttaattcattccagaacatttgctacataccagctattttgctctactctgcagatataaaaggcaaagaaggtatggcttctactctcaaattgcctaaagtctgtgttgaaaagcataattaactagcatcctagagtagaatttagtattaaggcaaagcctgtttatttaacaaatatttattcatcaagtgctttctgtgtgccaggcacatttctaaggctgtgggaatacagtgatgaactaaacagacaaaaccctcccctcttgtctaaaaggaaagatggacaatacatgagtaattaagcttagaaggcaagtggcttcgttttgctcactgctatatccccagcatctactgcagtgcctggcacatagtatgcactcaaatatttaggaatgtgaatcaaattaattagtacaatatttccatattttaaatggtcatggaggactgagaagggaatagttcattctggctacaagagctagaaaactccagcccaaccttgaacggtctataggaaattgaaaagtgatgtgagtagacatagcaatgccagatagaagatagaaaattctgcgcaaagtcatagaggtatgaaagagcatagcacattgccaatactgaaattcagtgtggccagagatcggagactgaacaagtaggctgaaacgtcattgttaaggtcttatttgcagggacaagattttgctatcctatggacaatggggatacctaaaagttttaatcgtagtgggccttaaacccatctacatttcaggttccccctttcctgagctacttttctccccgtagctctttgtgtcttcctccttcctattagtgctttctttttcctctcacttgtcaggcagtctatcatgcaattatattatcatgcgtttgaggctctttcagactagtcccttacaatgagcagagttaagtcctctttcccccttatttagacagtaactaaatcatttgccattttgacacccctagaaaggtaaagctacctctgcaacagccaatggggtgtgttgcacagtggataagaagactgcagcacaattcgtaccataaaggaagccggcagagtctgactcttcacattaaaaattaacagtgtgcaatatacagcaaagcctgccacactcctcccttgtgaagcgcataatgggagagcacccctccctggaggacgggaagggaacattttcgtacagaggtgccaatttaatcatcagaggaaagttctgcgaatcaaatggagggcagaactctcaggaagaggctggaggtttaattgcccatttgtgagtcctgaaatccccttatacgcttgtataagggccaggggaagtacatccgccgtgaagccttacccagtagacatgcagtaaatatcttctgaatgataaataagatcaaggatgtaaactggccacctctggcagatgcttcagcagtaagaatattctcaatattgttggtggaggctttaaggtttataaaggttttgcaaacgctgcctcttttcgtctttagcactattcagcacaaaacaggaattttcactattattcaaatgagcctcagggaggttaaatgagtctcccaaggtcacttggctggttagtgctgtggttgggacataaactcaggtctgccgaatgaaaatgtgggatgtttcctttatgctctgaaaacatagctcccatacagtaatactccagttctcaaagttttgtcagatgactgcttcagaatcactgcataaaagttaaaaatgcggccgggcgccgtggctcacgcctgtaatcccagcactttgggaggctgaggcaggcggatcacgaggtcaggagatggagaccatcctggctaacatggtgaaacccccgtctctactaaaaatacaaaaaattgccgggcgtggcggcgtgcgcctgtagtcccagctactcgggaggctgaggcaggagaatggcctggacctgggaggcggagcttgtagtgagccgagatcaagccactgcattccagcctgggtgacagagcaagactccgtctcaaaaaaaaaacaaaaaaaacagaagaagaaaaaagttaaaaatgcagagttgggggcctcaatcaatcaaccacactatgtagtaaggaatctgcatttttaaggaatctgcatttttaacaagggcaccagggacaaacaagtttgagaaccactgtaccaaagaacacctaacacaggttgaaatagtttaataaaagttacagaagtctaaattacttccaagatagggtggaggctgcagtgagcccagattgcatcactgtactccagcctgtgcaacagagacattgtccccctacccccaaaatattaaataaataaataaataattcccaggacaaagcttaaaaacaggagaacccacgtgtttttttaagaatctgtgaagacaactttgcacctaaatgtaaaagtcactttcaatgtcattgtcctgtggtagtgtcctctatttgttaatcagttttgacttcaaaatttcccatttttaggggccactgataattttatgagttttgaaacttttggtctgtttatttgtcctaataagcttcttttcagatacaaaaaaaaaaaaaaaagaaggcttgatttgttttgctcaacagcaaatcacaggaaccactatctcttgtgttgggttctattctttctagcccagtggcaattgctgtaattacagtgaaacttgatgaataaatgtgtctctatgaattttaaaaatctgaatatgtgctatgaatcaagttcaacagacttagtaatgatggtgcaaatcattcactgaaatgtcagaatgtgtatttagtaaccacacgttaattctcccttgtatatttacacatatgccagcttttaaagcaagtgttaatagttgatagtgatataactttacatttctgaaaatagtcataatgtagaccttgactggttataaataatgtcttcttaattctattccagtctaggagttgaaatccagaaatgactgtcttttctttagatcctggtagcaaattataattgtgatgaatgcattctcgtaccaacggtttagctaaaaattattcctgattattttggagttgtgttgcttgccatgaggttgcaagtctatttctacacaaggggtctaaatttgcttttgacctcagcaattcaaatgtgcatattttcttttttatcttaagaatttattgggacaaaaaaatagacaattgctttttgatttcttatttatagccaggagtccctctcagcccaaagtcactgttctggaagctggatgcaatttctaccttctctgaacttttgaagtatattgtctttctttcatttataacacatcagctatctatagtagtatttttattattggaatgcatgccatttcctctggaaataaatttgctattctttaaggaatggtcatatttataagtttttatatcctaaacagtgtcttagacaaaatagatactgtagtagttagcctccaggatgttcccaaacgatttatgtctccatatatctgtgcccttcccacaccgaatccaggctggtcttgtatgactgattgaatatgccaaatgtgatgatgtgcaactttcaaagctaagtcataaaaggcactggagcctcttccttactctcttggatcacttgctctggacggtacgggctgctatgtcatgatgacattcaaccctttgatgatacccaagttgagaggaactgaggcccttgaataaaagctagtgccgaactgccagctctgtgattgaatcaccttggaagtgaatcttctagacctagtcaatatctgattacaaatgaggaaacctgaactggagtctcctaaccaaacaaattctacttcctttcccacagaaaccatgcagcaatagctgcttgatcacatatccctgaacatcttatttagtagatagaactttatgtctaacaaatgataatcattgctttaagctcataagtcttaaggaagttcattactctgcaataaataatgaatgtagaattctatggctaaaggcaagattataacaaatgaaagttcaaaatatttgatgcacactaaacttcatgacaatgagtctgtatctcactctgtgggtgatgtgaatatttttagagaaaagttactttttaactaggcattacaagaatagtatatgggtgaggtagagaaaggcaacttcaatttgtagcaaatgtttaaaagattgatggctgggcagcttcagcagctggccagaagatttgatgtccttgtaatgacaaagtttgttacttacagaagaggtagagagatattggcagtttagaaagacctttcaagaaacccttgcagaatgatagaataagtactccccaaaatctgcttctccataaaggcaatgagaacacttgcaaaagtcctcaaatgtaaatttctagagctctggaaattaactaagggcttataacagtctaaggagcacttattcagaaaaaacataagtatcagtaagaagatcaagatttatggaattttagtgtgccttattttcatcaccctgtcctcagatctgcagtatccttgaaaaccaatagacacacaaccgtggtacttgttagaaaccaacagtctagcagccactcaagggaaaaacagttttggggctccccaaaagccctcttcccagaaaatttttactattttacttatccagtggctccctataaatgcccaaagtccagggcttgtttttatacaatctgactgaaatttctctgtgcaaacagccctatccccagggtgtttgtcaaaaataatcaattgcagttgtttaatgttgcagctttctgaggcagctgtacaagtggcacaaaaggaggctgaccaaaatattttaaaggaaaaactgggatatgagatatccatagaggcatttgaaatgctccaatatatttctgggaatccagaaggcaacatgcatgttcagagctgtgcttatccccagaaataaaccgaaaatgccccaagctttaatctctgactggcattgaggctcagcaaagagtaggaagtgaaggctagggcagagctgtaaactactggagcattggaggcatgctcataaacacacagcccctcaacagaggctggaggatttattgattcaagtcatttaaggaaaatttgttcaatcactgcctgatcactaagccagttaagcagagacatagagacttctatggatacaggctacacacacacagaaacacacacacacacacacacacgtacacacacacaaatatatactttacagaattcatccaggaaactcattaagccaacaagcagcaacagccaaaacaagaacgaatagcaacaataagccctggggaagtatgataggcagaataatgctctccccaaaagatgcccatgtgttaatccctagaacttgtaaatttttgttacacgttacatggcaaggaggaattcaggttgctagcagctggattttaaatagcaatatcatcttggattatctagatgggcccaatgtaatcacaaaggttctttaaatgtggaagagggaggtaaaagagttagtgttggagtgatacaatgtgaggaagactgaaatagtcattaatgacttagaagatagaatgggctgagtgaaggaaggtagacagcctctagaagctggaagtcaagaaaatagattgttctataaagcctccagaaagaaatgcagtccttctgacatgataatattagcctggtgagacacattttagacttataaccagcagaacttcaaaataataaatttgtgttgttttaagttactaaattttggtgatttgtttcacagcaatagaaatgtaataaggggtgaaggaggatctgattttcagagtgtccagattatatattttaaaagtccactaccaaaaaagaaacgtatggcccatacacaggaaaagaagccaatcaatagaagctatctctcaggaagatgtatgttggacttactatacaaagactttaagcaattacaaatatgtttaagggactaaaattacctctaaagaattgtggagagtatgacagcaatgtcttgccaaatacaaattgtcaataaagagacactaaaaagagccaaatacagattctagagttgaaaattacaaaaactgtaatgaaaaaaaaatcaatggcaaatcaagtagctactggaggggacaaaagaagaaaaacattaacaaacttaaagataggtcaattaagattgtccagttcaagcaaaatgaagaaaacaaaatgagggaaaatgaacagaaaaatgtgtgtgtttaaaccttaggatcccatcaagtgtaccattatatagatgattgagtctagaaggagagaagagagagaaaggggaagaaagaaatttgaagaaataagagtctaagtcttcccaaatttgatgacaaatattaatctacagattgaagcagttcaacgaattccaactaagataaactcaataaaactcacacctatataagtcatcgccaaactgttgaagaacaaagacagaatcttgagagcaacagagaaacatgacttatcacatgcaaaggctccccaataagactaacagatgacttttcaccagaaattatggaggctaggcatgtgaaaaatgctcaatatcattaatccttagggaaaggcaaatcaaaaccacactgcaatactacttcatacctcctaaaaggctaaaacagaaaaaagtgacaactgttgataaggatggagaggaactggaaccctcatgcatgcatacattgctggtgggattataaaaggttgcagaaactttagagaacagttaagtagttcctcaaaatgttaaacatagcactgccatgtgatccagagattccactgctaggtatttgccaaaaagccttgaaaatgtttacagcagcataattcataatagccaaaaagtggaaacaaccctagtgtccatcagctgctgaatcaataaataaaataagttgtatatacaagagaatattactcagctataaaaaagaatgacataccgatacatgctacaacacaaataagcgttggaaactttatgttgaatgaataaaggcagtcaccaaagggcgcataatagattatttattgattaaaaaaaagttcaggatgggtaaatctgtagagacataaatggattagtattttcagggactgatagtagggaggaatagagagtgactgctatgcaaattgacaggggtttctctttagggtggtaaaatgttctaaaattacatattagagatggttgcacaactctgtgaatacactcaaagccacagctcttttgcaacatgagggtattatttttagggaaaatctgaggattttttttaaggaaaaatggagggttagctaaagagctatagtccttgagctcagtacaaaaaagtatcccataagccacagtatgtgactaatgattatgtaaaaaagctacattccatgactaatgattccaattcctactctgaaaaaaaatcaaagaaaacacaagaaacatgagatactgttattaaccttagcgggtttacttgaaatatgtacattattcaaatgtactaagatgtaaaaactgtcacagaaacatgaagaggccgcttaagagccctatataaataaatatatattctgtcatatttaatggatgaattacaactctaacttgtcagaaaacacatacatttctgggtgtgagctgccactcaagtatttgcaaagtggctcttgaatgatttgtgtgattcacaactttgacattatgtctgatgaaatgtcagtgatacagccacacatacacgaattggaattctagattttaaatatgtaaggggacatatatttatatgaagggcctattttaaaaacttcaaacacttaagaaacttgaagaattcaagacttattttcctatgagagtacatttatagaatggggcatggagaccgacaagtcttcactctcatattgcttattgtcttctcagtattaactctgatatttctcaggatccttgtaaataggcaacatggtgtattgtgttggttttttgccttcctttatagtgtttttagagcccttcccttcccttcatttttaaagtcattgtttttttcagaagcattttgttttttgaaacagcagtagaactgccacttaaacaatgctcaaataacagggttataggatatttaattaaaaaaatatatatttctaacttgcaagaaaatgcatattttgggacatgaatctatcacccaacatattttaaaagtggttattgaatgttataaaaacagtgcaatgataactaaaacctcttatagaagttttattccaaataaacaatgacatggactagcagtttgtgagaaatgcaaaaaaggccccattccagatctacagaatcaaaatctgaattttaactggattgtgctttataggcacattatattttgaaaagcattggtttgcatggaactgaaaaatggtggttggtattttggtttaaaagataattgtggtccatcgcaatagaggaaataagtaaattgatatggttttgctgtgtccctgctcagatctcatcttggagtcccacatgttgtaggagggacccagtgggaggtaactgaatcatgggggcaggtctttcctgccgccaagaagacagaaaaatgtgggaaagtttggaacttcctggagacttgttgaatgactttgacaaaaatgctgatagtgacatgaacaataaggtccaggctgaggtggtctccggtggagatgaggaacttgttgggaactggagcaaaggtgacatttgttatgttttagcagagactggcagcattttgcccctgccctagacatttgtggaactttgaacttaagagagatgatttagtgtatctggcggaagaaatttctaagcagcaaagcattcaagaggtgacttgggtgttgttaaaggcattcagttttataagggaagcagagcatgaaagttggaaaatttgtagcctaacaatgcgatagaaaagaaaataccattttctgaggagaaattcaagcctgctgcagaaatttgcataagtaacaaggaacccaatgttattgcctaagacaatggggaaaatctccccagggtatgtcagaggtcttcatggctgcccctcccatcacaggcccagaggcctaggaggaaaaagtgagctgaacccagggttctccatgctgtgtgcagcctagggacttggtgccctgcagcccagctgctccagccatggctgaaaggggccaatgaagagctcaggtcatggcttcaggggatgccagcttcaagccttggcagcttccccaaggtgctgagcttgcaagtgtacagaaatcaagaatgaaggtttgggaacctctgcctagatttcctagtgtagatgtatggaaacacctggatgtccaggcagaagtttgctgcaggcgcagggccctcatgcagaacctctgctagggcagtatggaagggaaatgtgaggttggagccccaacacagagtccctactggggcgctgcctagtggagctgtgagaagagggccactgtcctctagacctcagaatggtagatccactgacagcttgcaccatatacctggaaaagcctcagacactcaattctagcccatgaaagcagccaggaggaagtctgtaccctgcacaaccacaagggcggagttgtccaagactatgggaacccacctcttgcatcagtgtgacctgcatgtgagacatggattcaaaggagatcattttggagctttaagattcgtctgccctgctggactttgtgcttgcatggggcctgtagcctctttgtttcggccaatctctcccgtttggaatggttgtatttacccaacgcctgtttacctgctgtatctagaaaataacttacctgtttttgattttacaggctcataggtggaagggaattgccttgtctcagataagactttggaccgtgggcttttgagttaattctgaaatgagttaagactttgggggatggttgggaaggcatgattgtttttgaaatgtaagaacatgagatttgggaggggccaggggtggaatgatatggcttggctatgtccccacccgagtatcatcttgaattcccacatgtggtgggagggacccagtgggaggtaactgaatcatgagggcaggtctttcccatgtttttcttgtgatagtgaatatgtctcacaagacctggtgattttaaaatgggagtatccctgcacaagctttttctttgcctgcaccatccacataagatgtgagttgctcctctttcccttctgccatgattgtgagacctccccagccatgtggaactgtacattcattgaacctttttttcttcccagtctcaggtacgtctttatcagcagcatgaaaatggactaatacatgaatataaatacagtttacaggcaggatgccatggctcatgcctacaattccagcacattgggaggtcaaggtgggagaattgtttgaggccaggagtttgagacaagcctgggcaacatattgagaccctgtttctacaaaaattgaaaaaactaggtgagcatggtgtcaagtccctgtggtcctagctatttgggaggctgaggcaagaggattgcttgagcccaggagttccacctcacagtgagctatgattgcaccactgcactccagcctgggtgacagagtgagactccaccaagtaaataataaagtttacagatcatttagtctcccctataattttgatgaagctttttaattgacaggatttgcattagttcaaatacttcccatagtgggaagtgctattaccattttgatatcatactcattaaaatttgcataattcatgttgcatgcacatacacatacatatttaccacttctctattcccactaaaccctgaccaatgtgtttgttcgtttagacaatgcccctcctgggacacccaggccacataaaatagcaaagagttcattagaatggtgtcaccagcatagctataattaaggctacatcagcaattttggggcttaaaactccattgtaaagttgtattctgggatgaaactcagcacaaaagctcaacctgggagtagattgtttactagttctgggaggaatgtggggggaaattgattcagttgtttatgattcactatattgctcatctggttcttggtggcatttgaattaagatgttttatagactggtgatcatcgagaactggtattttcaccgaagtcttcatagaccttactgaaactgtaaatattacagaaactcagatggtgtcaactgtttatattctatgaatgaggacaaatatgcatagggatgcaattaaaagagaaaaggagtaattctaattaggcagaattggtaacatatttcatcaaagtaggacgcagagaattccttagttgcccacatatttctgccaagtagacaccaaggcatgctccctcgaatttgctctgggatatttaattggtaaatcaacattaatgatcagagaagtttagaaccagctcttttagaaaactgagattcacacttgacttctcttagatgtagctacagagctcatggctaaagagaaaacctcactaatgaaaaaagtcctggaattctgtgcttcttcagcttctttactactaccttgctcttttgaagagagaaacttgtcatcctgagacttctagctgtagtaatcaggaatataataggagtaagctcctattatattcaatttgtgattagatatattgtcatcttgggtacaagtttaaatgtagttttaggcagttatctaaagtgtagtcccaatctaaataattagaaactcctaattttccacaagggcttaactattaatggtgaatataatagttacaagctggaagtcttgaggaagacagaaccaagttcaaatgctcttcctactccttttataatctgtcttgtctttgggcaaatgacttaatacccatgaccttcagtttctccttctaaactctgatggtaataatagtagatatttcagaggatggtcaccaaattaaaaacttaaccctgggctgggcatggtggctcacgcctgtaatcccagccctttgggagtccgaggtgggcggatcacaaggtcagcagatcgagaccatcctggctaacatggtgaaaccccatctctactaaaaatacaaaaaattagcctggtgtggtggtgggcgcctatagtcccagctactcgggaggctgaggcaggagaatggcgtgaacctgggaggcggagcttgcagtgagccaagatggcaccactgcactccagcctgggtgagagtgcgagactccatccccccctccccaaaaaaaaatacatgaccctgcaaagcaccatacctggtatatggtaactatttattatgttgtgtgatggcctaaccaaaatttattttcaagttgtcatctatttcctcattcattcactcatacaacacatacttatcagttgcttccactgtgccagacatgctgattcaatgctggaaataatagtgagcagggttggcataatccctttcttattatttaatattgtagtggaaggaacagaccaaaaacgttatcaaagaagtaaaatgatcatgattttttataggtgttaggaatgaagcaagcaaggggttaagatggaaattaataatggagagatgggtatgagaattaattcagagtgttcagggaaggcatccaggaggaggtatgtataaaactgttacctaactgacaaacaggctggaaaaaaagctcaggaaagatactccaggctaaaagagaaacagatatatatgccctggggcggaaataccttggcatgcacaaggatctgaaagacagctacttggctggaccacaaggaaggtaaggtagaataatgagattagctgggaaaaggagaaatggacaaagtagcacaaagctttgttatccacgtaaggagtttagattcaatttagagaatagtgagatccctagaagagatgatgtactgaggtacactgtttaaggaggtgcttccagctggtggtggagaatggcttgaagaaagtcagtagtatctctctgagcttccttatggatcaaaggggaaatccccaaacacacgtctggggctattttgtagccagtgaattctgtgataaactcggagatattgtatgtttttactgttaacatatcaaggaggagagaaggtggtgctaagaacacacttatttgatgaataagagcagttttttatagcagaaccactcaagactacataattgctattttgaaacacacatcatcattcataatttcattaggctataacttacttccaggaaaactatattttatgtcaactcatcttccctgaacagaaaccctacttttggcatttttaaaatttaaaattctaggacatataccagatcagcatatttctttgatttctttcctctgtatgtagaaaatatttttaggctttacaaccctacattactaaatgaccttcagaacttaatttaagtgcacaagtattacagaatgaaagtggaattctgatcttcattaggattttaaaatttggatcatgttgttcctgctcattttgttcatctttccatttttcctccttttaacattggtctgcatttttaaagaaaatgaagttgtaaaaattgaactaggggttttctttttctgtactccttgtgtttctaaattattaaataataatgtaataacaagcacttatctagtgatttattaaagaacctcttgtttgcaactccagccctggagaacactgaaaatgttttctttgtaaagtttccaaagtaacatcagctaatctgcctcttcttgatgtaaccgcacaatgctagaatttttcacttattaattatcaaataaatgaattggataatagatatgtgaagtagaaaatagtttcttttggattgtcaaataaggtgactttgcttgaatgcatgctcctgaaatttgggaggacagtcttcccatctgtccttcatttacctgaccccatttatttgtatgtatgcttgtgtgaatgcaaataaattattaattatgcttaaactctatgaacaaatcagctagtgtacaccaaattttgacgcttgcataagattctttcctgcctataacacataattttattattattattattattattattattatttgagagggagtcttactctgtcacccaggctggagtgcagtggcaccatctgggctcactgcaacctccacctcccagtttcaagtaattcttctgccttagcctcccatgtaatgtagctgggactacaggtgtgcaccaccacacctggctaattttttttttttgtatttttagtagagacagtctttcactatgttggccaggctggtctcgaactcccgacctcaggttatccacctgctttggccactcagagtgctaggattacaagtgtgagccaccacatccagcctattttatttatatatgtcagactcatgttgagctgggttttcagattgtgagctgaaatggcagaggagctagatagctagtaacaagaggtaaaggatactgaacgagaacagcatcacacctgcaggcaatttttgtttgattagcccatattgtcccaacataagaagttcagatgatttatcgtaaatactgggatttatggtttcttttgaaaaatgagccagttgacaaaagtcagtaggaggtgagtagtgtctgccccttctagagaagatagatacttcccagtttgccccagtccctacaaccccttatttttcttggcaactgacatgtttcagtcatttacaattcttccctggcctctgcagacctttatgtgtgtggtcaccagaatagcaacatcacctatgtggtaggcagcttctaatacgacccctgatgatcctctcctcctagttttcatgcccttctgtatcccctctctctctgtgtgggctaggcctagtgactttattctggaaaaaacaaccacagaatacagcaaaaacgaagtgatgtgccttctgagattgggttataaaaggtggtgacttccattttgctggcactcttggtcttcccttctctagcctagctggttttcatgaaacaagctgcaatgctgcataaacacacaaagtacggacgagaaggccacctttggccaacggtcagcaaaaaccttgggcccttggtccaacaaactacaaggaactgaaccctgccaacaagcacatgagtgagtagatccttctccagttaagctttgagatgagaccataactgttgctgtcatcttgattgcagcctggtgagagactcagtcaggtggggctggctagtggggacccagccaaattgtgccccaactcctgatctgtagaaactgtgtcttgttttaagctgctgaaatttagagtaatttgttatgcaacagtaggtaaataatataccttactccagagaaagatggtgcactgactagaacatacaaaaaaaaaaaaaaaaacttccttagaattatgtaagtgaaggcagtaaatttttctgttccagtgaatatagttttggtctaataactgatgttggaggtactcagtaactatgaagtaaattcagggtaaccagtggtgagttagctgttatgagagactgttatactgataatgttgctaatagggtaattattattttttatgcactgtttagatttatcttttaaaaattcccttcatatgtggttccaaatattctgattatctaaagtatgtcttagatacaaaaatgttagaaactattgatcaagacaagttcccagaatactagactcctaatggagatgactggaaatggcttagacatctgttgtgggctctctcagcacacatcgaaaggaaaagagtggaggttgcaacactttcatctgtaaaatagggtgaaatctaagttatgaaagaagcagagcagagctaaaacattgtctcaaagatctggatgtcattccttacttttaaactatatgataaatacagtttacaggctggggatggtagttcatgcctgtaatcccagcacttcgggaggctaaggcaggaggatcacttgagctggggagcttgagaccagcctgggcaacatagtgagaccccatctctacacaaagcaaaaaacattagctgggtgtgggtggcacacgcttgcagtcttagctactggtgaggctgaggcaagaagatcacttgatcccaggaggtcaaggctgcagtgagtcatgattaaaccactgtactccagcctgggtgacagagtgagaccctgtctcaaacataaatgaattcataaacagacagacagacaaactgtgtaacccttaatggatttctcagtattacattaccaggtggaaaattggatactattcatttctttattcagcaagctttgtaaaagccccagtgttgtactgtgtattgtgctcagtatggagatacaaatgaatgagatgtatagtgtgatgcatggtgccgtcagcttctggggtggtgacatttacatacaatgcagtagtatttcattcaaaactactaacagtttaacatccaaatatcagaaatgggaattagaaattattgtaccaggttattgcttcaattggtactgttgttattactaatttatctgatcctatagaatactgaatttatcacattaacatgaacaacatccaacacccctttaaagtacttaatgcacaacactcttttaaagtacttgtcaacatacacacattttaatgtgagttttaacataatgtcttacagcccttaagtcatttctgtatataaaccttgcattcttgtaaaccctacgtaaaacatattgctttatgcactatacacatttattagcaatttcagccaatttagtttattatttagtgataatgtcatgttttatggatgctgtttatattttatgcatatggtggtgataagaataggttggattgcattgaaaatataataaaaagaaatataatttgtgtctaggttccagaggttcatagataaaatgttgaaacaaatcatcaaagtcatgtatctttatttcagttggttcaaccaaccctcccaaataattatcctatcagaaaattcttgcactactcaatacatttgacctgagcagtatgtgtgtagttttatcatcaatcaatagtatacctgccccatcgctttgggtgaaatggtggtttgagagggctttaattcttcaaaagatccattgactagttttgcccaagttcaccttttaaagttatcccaggaccacttattgtgcatcaagtatgagaagtggagcaaaggttaatgattcttaattggacttcattaagtgataatataagatctcgagctcctcattatgccccatgattggacagcaatgtcataacatcaggaaataaggaaccagaagtcatgcattgtcatacattggaacactctagcaacttattatgtttcagatacattgtctttagtgaggtataaaagtgaggtgcatattaatagcttgatgaagttcccattttaagacaaagtatatttttgatgcaataaagactttgattggaactattatgatcagaagactgttggatcctgtatatcttttcttattatttattagctgccctcaacagtgagaaggttattggatcatttcacagcttatgcagtctaattgaaacacagaattttgttcatgcatcacttttgaatttagggactgttcattctttcattacctgtgtggtgatttccaacccactttggtaatacaagggattgtgatagcatatttgctcctaagcacattctatttagatcagagtcagttctatagttctcattttgctctgagaatgggaattgatgcatacaaaacagtagtaactgtagttaacatgtcagggaaaatgaatgcacagatgtgtactatataatgccatgtgcttcagagataaccacagtgagggatgtaagctaaccttggtcttctgtaatgcaaagctaatatattcaaaaagatattccccttcattacgatttaatgtaattgttcctaatctgtaacctgaacaaaaaactcaaatgtcttatccaaacactaacattaagctgcttttctccaggatagcgatatgacactttacattcatatgcctcagagaggaactggacatcaaaaagtgtcatacatgctgtattctccctgaaattttctgcgaatttccgtgaataaggaatcaaatgattaggttgacactaacatttatgataattcagatgattgacagaggatggatacggtaatgaaatagatcacctccacaagttacatgacagcgatttcaaagcattctaagtcctacctgaaagcaaatatcaggtttgataaaccttgcagggctggaggcttagaaaattattagagtctgtatttggaaacactgtggctagaaggtataccaacatattttctacatttatgatgataagcactgtgtgcatgtgtgtgtgtgaaagcaaaagaaagagagctgatttttattctctataaggataaaaattattattttttgcccctgaaaacagtctgaaatgctacataggtaatttttggcatgtctcttctatccctaaagcaggactattgattagctccaatatatactgggaacacgaaagctcccatttgctaacaaaaacaggtgttgaacgaatattaggtttgattaaatgagcaaaggttaactactcactcatgtgaaattgctctagagaaagaaagatatcaggcccaaagaatgttgactgccatatgtatagatttaatatttttcatagtggcctgtggaccaccattttacttgttaaaaatgttcactcttcaacccaatgtgatgaagcagattcctatgggctgagacatgggaaagtgtgttctgcaaaaacacccgggatgtttttctacatccttcacttgaacaatcactggtatacattcaatttctcatttgaaatgctgtttttcttcattcaatttaaaccaataaatatttaaccctgctatatgtcagggactctgccaagacaattgtctaaaagcctctgttctcatgacactcctaggctatcagagaagacagacatctgagcaagcactaagtggagatgtgtagccagaggaaccagtccgcatgggagacagcaagaagggtattcctgaggaagtgacatttaaagggaccctggaaggatgagtaggagccagtaaagtgagggtaagaagggaaagagaagggaaaggacgtttccaaatagagcaaatcacatttggggagccaacatcaataaagaagaatggacttgaaatacagaagccttaatggcaggtaaagagagtagaagtttgtggtatgtaaggaggtagaagggactggaacctcaaggatggtataaggctgtgttttccagtctttggtattttcataacattttcatggtttgctccaccagagtacagcttgtactgttatttccttaatttgttgcattaaatctattcacttcttgtcttaaatgaatttattttaaaataaaactttgtatcgctatgtaaatgcaaccacagtatcatctaaccttagtagaaagacacctttaaaatgaactattacaggtgcagtggctcacacctgtaatcccagcactttgggaggccaagccagatagctcacttgagctcaggagttccagaccagcctgggcaacataaagaaacttcatctctacagaaaaaatacaaaaactagccaggtgtggtggcgcctgcctttagtcccagctactcaggaggctgagatgggaggatcccttgaacccaggaagtcaaggctacagtgaaccatgattgcacttcaacctgggtaacagtgagaacctgtctcaaataaaataaataaataaataaataaataaataggaaacaaaatgaatttgataaatcctaactcaatgttgatttcattagaagatgctgagcatgaagcctgctccttgtcaaaaagggaggtgagcagtgttaggaggtaaagtcctccaccctactagcaacatgaggctttctccttggaaagaaagctggaaaaacaactttctcattgtgcaactcagagatgtttattgccttagctccccctttggtgtgctagcgaatatcatcttgagggtcttttataatacatttctactctttgggaataattgttattaatcatgaggattttgagttttgttgccagggcaattacaaaccagtggataacttctaaacaggtcctggtgtgcttccctaaccctttccgcagaagtacccagaacagcctgaaaccagagcagtaagttgaaaatgcctccgagttcccaaggtctcttttaagcattccaatgtgatgttgtactccaaagcataacacaacccctctctcattgtaataatagatcattgaatgaaacctatgttttactaagacgtgagaactgaagttagacttttgtttttttcccttttctttcaccattgtatgcctcatctcttgtactgggacagacacgttgtagttgtatgattaatatatgagaagaatgtttatcccatccccacctggagataagattattgttgattcttctgtaggtatctctacctgtctacttaccgtcctttatccagggacccaacctgcctgggctttccttcctccccaactccctctcattaattcattcatcgaacattggtgtgtgcctggctctttagtaagtgctcaggatgcattgaattgctccaggctgctgaggaagctcaagcttttgggatggcctttaatttctcaccttgctaggagatgtcccttcaaaacataccatgggcctagcccacatatgattcttctgaaaatcatctgtccttcttatctctgtgggtaattagcagtttcttgagaatgtgtgaagtttgtgggaaaaaaaaaagccagtttgcttttcttagatatccatcccatctttaagtttatattcctagtttcaagctgaactttcaggaaattaggagtaccttgtcaataatgaaaccttgaattctgagtaaattcattttacctgttattatttggtgtggattaaaaaataaaacatgaatattgtcttttacgtgtgtcctccatgcaaaatttgacatcaccttctgtttataagcagcctctcattatctttttgtgtttaggggagtatagcatataaaaaaagaattgtacaaatataatgtattacttaatggattatcacaaagtgaacataaaaaaatagagaaataaaacattgtcagacttagatggctttctcatgccccttctaatcaccttcatccctggccaaaggtatgattctgtttaactctagagattagctttgtctatttttgaactttctatggtgggctgatacactcattgtggcttcacttgttcaacagcaggtttgtgaaattgattatcttgggtgatatagctcatctttgcacagtatgattacaggacaaattttagaaatcctctgtaatactggttttcaatttggggctattacaagtaacaatgccatgaactttcttatatgtgttttgggagcatgtgtcatgcatttctcttaagcacatacctgggagtgggattttggatcatcatatgcaaagcagtgtttagttttagtagaaaatgccaagcagttttctaacacattacacagcttatacttatcccagaagcaatgtatgatcatctttttggtcttaaattcttgccagtgcttggttctgtcagtccttttaattttggccattttagtgagtattatggtagcattgcggctttaatttgcattttgttaattactaatgaagttgagcaattgtttgcatgattatttgccattgggatattctgtttaataaagtttctgtttacatttcttgcctatttttctattgggttgtctagctttgtcttatagatttgtagaagttattttatattctgaatataagaccttgttatctctgttccatattctattctgtggattgcctattcatattcttgaggatgtttatttccttccttgcttttgaaatgaatagaagttttaattttaatgtaattaaatttctaagtgctatttgcattttgtttaggaaattctaaattagagaacactaaattccatactgcgtaacttttttggacattgataggaataagtttgcaaggttgattccaccacatcacttgctaagtttgctattttaaatagtcatttggctttaatacagaattttaaaatggatgattttctctttgcatctattctgcatgtcttaaaggtttttttctatttcttagctatctttctaaatgttttgctgtacagacatttgaaagtagtatctctctaaattatatatatatgtatataatgtatgtgtatatatatttatatatatatatatagagagagagagagagagagtaccatcagaaactagcatctaattttatttttatgtatttataacaatttgaaactaatatctcttatatctatgttatgtttacagaaccagccttggcttttgcagttcagtctttgtgtttccattaggtcattaagtgtcttagagagagaggaaaattgtttttttaaactctgaattccatgctattttgcactaaggacagaaccatggtagggaacaatgacttttgatgctgaccaacattttatgtgatgcttcttttgattaatttttatcatccagaatagtgggggttttttgttgtttttttgttcgtttgtttgtttgttttggagctttctgtttccttcatggatacaaggccaggtgtgcactttgaatggggacgacttgtgaccatgcttgtgtcttcataggtccagactggtcagcagttttagatggtcagactttccaattggtggtacactaacgattatgttctcagggactgatttgcaccaaataaaatccttggagtgtgacccaaaattttggaaggtaaaatcatagagtggaagttctgtgaaggtgaggactaatgttgttcatcatcgtattcccatggctgggcacatggtagatgctcagtaggtgctggcttattgaaagagaggaagactgatatattaagtgcaataaccagcactttccatttcatccttggctgtttccattcagtagactcacctacatgcctctgttttatagtacaagaaatctagccctagaaagcaacttttgttaaatgttgcttcagactgatctttactaccattcaaccctgtccttgtccttatttccatttttaaaatttttggctctgtacaccctgcttaaatgtcagctctggggttggcaagccattttagctaccttttgtgcacatatcaaatatgcctgccctctcagagctctgcccatcatcttgatttcatggcctcattgagaccttcccacttccagctctgggcctttagaagttcacaccctgggccaatgactggtactcagtcaagaaagggagcaaggtgagaagtatagtgggtaagttctcagttcagataaaaatggcctgaatcaaagcttgtctatttaatttgaactatttaaagtctctgagcctcagtttcttcatttctaaaatgaggatagtaattataccttcctcataggctgcttcaaatataaaataagatcatgcaggagaagggtctggcattatgcctggcacaaaagaagctgccgttaatattgctgttgtcactgctgcaattcttattgtcaccattgatattattagtcatcaacatgggggaatttctcctagtgtgttagtgaactttgaagacccagttacagagattgcttggtgaggataaattagaacaaaggaagctggcaagcctcatagatatttatatcaagctactgtggttgaatgaattgtctttcttcacttgagggaaattctgtcaaaagaactgctatcagtcatgtgaaatcagcctgatctctttcttgagtggtatcagaaagagatactaacgaattctaacattttgtcattctttttttccttcaggattcattgtcagtcaccaaaacttcttttatgtctacattaccctgtagtgaaagagatgatgaattaggtcacagcttatcttgctttcactcattacagcctagcagtctttctgatgctgggagcctggctatacttctggataagtttaagatgatagcaacatgtcactgggaacacatttttaagtgtttcttgaaaatggttccacacacccatctgaacttgactttcattgttcattttatttgttttctgaatacaaaatattgaagtaggaaaagtacccttttagagtccatcacctcattgctctgtttctgacaatgtgcttttaagaccattaacctcagggtcatttggaatctgggtaaaatgtaaatcccaggcagttcctcagtcttcctgtttttgctctgtgtcagtgggaacacttgtgttttcagcaggtgcccatgggattctgctgcacattaaatttgagatccatagccttagtttcttatggcggtaaataaaggtatgtgttttgggaggagtttgtgagaacagaataggaaatacaccatgtgggctgttaagttttttttcttaaaatatctttatgaaccatggaaagataaatttttcatttattcctaattaactatatatcttgagcttgtccaagcaaagtaatgtgaacttccaatgagactagagtatgaattaaataaaaaagtatccatcctgaggcacaattttaacaaatacctctcaccccacattgatttcctagtcattttggatactgcctacattgtactacttatgttttaaaaaccttaagactcatctgcgtagcttgtgaaattcagatatttggattcagctggtcttgggtggggacttaaaataaaccctacatgaaatccccatgtgaagagatgggagaggtgaatgctgttttatgatgagtctattgtgtgtctatcttgtttttgttttgttctgtctttccatttttaaattctgtggtaaacacattataatatatattttttctttgtggtactttttcttctgatattcctcatatggaatcctcaacaacaaggcaaaaagttgagtgtgtgctcagagtagtacatattaatttagagcttaaagacatttcctgcaggacatgtaggactattcagcatggcggtatttattaagccggttcaagcaatggaaaaacgtaactatggtcagagtgaagctaattatcttcataggtaaactgaagctgaagcttgtggcacactaacgatgctaagctaaaagtgtatccaattatttttgtctttcttaatgtctctattggtttggctttagtacatacctgtaggattgatgaattgaaatatttgaggaaatgcttatggataggtcaaattggactgtgttcatcagctcatcctaactctatagttgccacaaactttttatcacagcaaagagagtagaatcaaagaaagggagataagacttttttaaaaaagggccactgctcatcttaaggttacaacatattaggtaaacttggtttcatatagattttgtacaaatacaagcccataagccacatgataatgggcacctgattttcactgtgggtaattctggaggcctgattgatatagttattatctaagacgtgatttggtggtgttttcgtaaactcttcaatgtcactcaatcacttcaacgtcattcaatcaatgttgaataaattattcactttctttgcttcaaccattcttaggtgagttctaagtataggatctctttctatattcttggtttatctgcttttgctttggtttccctttcctttctaaagtcccgcctacatatatcatcagctttagttcctaagtgcttcttgtcttttcagctataagagcactattcgctctagtccaacaactatttactgagtaactactaggtaccagatccaggtgctgtaagggaccgagtgatacagcttttgctctcatggagattatgacaattaaaactaaacaggagtgattaaaattatgataaatgaggtcttttcccctctcttgccctgtaattctctccaaaatgatgcatttggcaaaaggttgaagactaggtcactccaagataaagttctacctccttcaccacctggcctccatgtctccattatgtggtcatggcatctgccagtgtgttacgaatgaaaacagatgagaaactgaatgtgtctgatgggaataccgcaagttgctcattgagcaccattatgatgtgccttcatcatcccattgaatggaatctgaatttgacaggagcatctctagagagctgtatagttcacaaacaaaacctaaaaagttaagagaaatggaatgcagtttttcttgtgctatccttattttatatatcaatatcctttctgttgaataataatcatttatccattgatcttgaaatagttcacatcctgcaatttctttatgttaaatcattagtattaaaaaataaaataaaattttaatcaatgatttagtagggaaataaaagggacactccaagcatatagcaaggggtgttatctagtctaaggaagtaaaagaagtaggcttggagggtgtgatggatcagctgagacctgaaacttgactaggaatttactcaggaatggaagaggctataatatagttcagaatagggaacagagtgtggaaatgtgtccatagaggcacaggagggctgagaaggaaaacatacaaagcaaagttgaggttgtctctatttgagcccaatggtgggcatggacagatatggtagtctccttaaaccttaataagatgctgagctccatcctaagacgatgaaaaaaatcactgaagtgttttaagtatgaggaattagtcacagtacctgcctcttcttcctaaataaaaaataagctccaaagtaagttgggatagcagaaaagttggaaaaatcttaattatacataccatgctgctaactgtggtatttagggaatggaatctagtaggagagagattttattttaagtacttttctactattcaaacatggattattttgtaataaaaaggtattttaatgtaagtttaagagataataaagcattgtcccctaactgtaacatttttaccaaaaatgtcaaggaaaggaagaagttcaatagaattcacagaaataatacttatctaaagcaactgcctttgaaacttaaaacagcaaacaagaaaacagaaaagtcagatgtctccttccagtgtctccccttttcatgtattgatactcaatagtttcttgcattctcaacaacagagaattgaacacagttttgtttgttaagtttgctgcatttttgagtgtagtttccattatcattttgaataaaacatctttccttaagcaaaaatgtttctgaaattattatgcaaatcaataggaaaatacaattttcttagagaaattctgtttttcacatttttcaggtttaaaaagcctaggctttaaagtggattgcaaaaaaaaaatgaacaggtctcttctgtatctatcatatatggtagctgtgttagtcaggtttctgccgccctaatactgtgtaacaaacaaccctcaaacccagtttcttacaactgcaaacatttgtaggtttgtgggtttgcagttcagttgtggtcttgctgaccttggctgaatttggctgagcaaagttatatttttaagctttaggcctagatatatttatgcttttgtcagattcaagtccacttcatgtgtctttgttctgagacttgggctgaaagactaatgactctctggggcatgcttttcccacagcaaagggcagaaactcaacaggactggtgaaatgttacaatactcttaaaattatggcttagaactggaacacagtcatttctgcccactgatcaaagcaagtagaatggccagcctcaaagtcaatggggtaggaatgcatactgtccctccacaggaggagtcactaccaagccaaatgacaaagggcatgaacagttctaccctggggagaaagtgaggcattaagagcagcatttctatctaccttggtggctgaagtatgatcaaatggaaatctacattgttttccccacgtagatttttccggtgtgcaagattggaattccatagccactgagaacaaattaaaaagatgagactaaccagacaattttctttgcaaatatgctgatgggatatctgatgacaattgattcaacatcaattgctatgcaatcgttatgaaagatatattgtactaaaaaaatttaactaaataatatggaagcaatatttttgttattgttgttgttggcagggagtacataatatctatgtaagaaataatgtaccttcagacttccagcctccagaattgtgaaagaatccatttctgttgttgtaggccacccagtttgtggtactttgttatggcagccatagcaaactaatacattagctttgcaacttaggacaaaatacttcaaagtatgaagtcttagtttccttatctttaaaatggcagtgacatcagtagctgtctcatagggttggtgtgaggttttgttggtaaagtgtataacatagagaccggcatataggaagtcttccctacaggtgtgtgagcgtcatcatcgtcattatcagtactaactagtaatagttgtcttctcccacatttctctgtagtagtcagtttttcggtatgcccatttaatttcctgtaatcctgtttaaagtggatatatcccttacatgcccatccatgtctgggtcctcacatgctgcttcagtgttctcttcatatcagaggctgaatgtatgcttgaagaggttgtgactatagccttaaatagcccagagcatttggaaatgttctttcaagccttactctaatttggggtttgccttgtaatatatgtgcatttgtttaaatataaaaatggatgtttaaattactacttaaaatgcttaatttctttctaaatccttaagggataagtctgtgccccaggaaaatacaacataaggcttcttgtgcctttacactacccctacccctggtagactgccacagacttctgggattattggcatcctagattaacagtttgagtttgaggacttcttgtatataggtgcttatgatcatgtcttatctgaaattcgacattatgaccattctgtctctaaacatcagtacctctagaccactggttctaaaccaggggtaactgccccaccgaaaggacatttggcaaagtccagaggcatttttggctgtcacaacctgttttgctccttggcatctggtgggtggagaccaggaatgctgttcagtgtactacaaggtccaggaaagacacccatagcagaaagttattcagcccaacttgtccaccatgttaaggctgagaaatcctgttttcagccatccctagtatgatcacgctatgtttgaatatatcaggccacagagatttctacttttcattagggttcttataatataatattttcttttttcttttttcttctgtctttccacatagatccatatcatatatgtctttgtatttcctttaactctcagcacccaccctggaaagtagtaggttcttgataaaatgtttacggctggaatctactgctgtgaaaatgtcttggacccatgtcacttataatgtacatatctaaaaatattttctctcttcttctggtctcaatagcatcagaaatgtatagagttttagagacagctgggcttttagaaaatgggccacagatcacaaagctgaggttttgagaaataatcctcatctcaggacaggtatatattaagtggatactggtcaagaatcagggtcctagttctgccctttgcatctgtgtataagcagctcccatccggccttgactttcttctgttcacgtaacttgtaactttcccctaagtcttcaaaagtggtaaaatggaaatagtatgttcataccaatgggcaatttgcatttagttcattgttctgtgtctacagtcctcctggaagcattttctaacggtctcagattttctagatttttctgaccaaatactgaccaaatgtagcaatcaatcaatcaatctatctatctataaattagtcaattttggtgatacttatgtgggatctatatttgttctgattcacctgctttccaatgtgcactcagcattcttttagttgaggaaatgcagttcaaattactataaggaaaaataaagggaaatttattgcctaaatattttcaaagccccagagtattgcatatagggagaaaaatgatgttgtcatatttctgcctctcattcttactcctgctctatttttctgtgttatatttcatttgtgattggaaccaaggctcaaactgctgttgttagtgctccctgcccctgtccatctcacagactggctctttcactatgcagaaagatggccaccatccatgcctgctgagtgaccatgccccatagcttctttagaacagtcctaggaagaattttaattggccctgtttagctcatttaccaacaactgaactaatcactttggccaaaggaattggattatttgatcagagccaaccacatccttctggccattgaaagtggagatagtctctgccaactgcatggaatggatttcacagaagaaagaggtattttgttaccaggataatgtgtgagaagacatcctggacaagaaaatatagtagaactccaatatattagatgacctatcacagcctcaacatgtgtcactttcttctagaaggcctagaatcatgctttagacatgctttaaaccccagcagtaattggtaaatatatataatcaccaactgaagtaaatgtgtagtaatttactatgttaagtattgccaatacaggtttatttagaaatatttgccagctttcttttatttagaatgatttgcccgtaaacagaacatttatactgtgctaaaatatatattccctgagtatataatattgctttttaaaataaaattatgaaatgaaagagaaataagtgggtatggtatggagtatttgcctttataagatcaggtgtatcttttagaattacttgatttttacctggcaaattttatgacagttcaatcagaaggacaagctcctatggggttcgggaaatgcaatgaaaattccaccaggcaacattcagaattcaggaccacggtggctttattctccatatcagtggcaacatctaattataaagaaagaaatgtcaatgccttttttttttaattgctggctggtggttgtattaaatctaaccttagttgacagggactactcaaaattctctcctacagaaatgtacaatcgagcaaagcatgaatatatctttgtcaaaacagcaagcaggagcccttgtttaaaaacttaacaaaagtaccttcaggctcaggctctgatgatacacttagttgcaaattcactggtgagaaaaagcatttggaaagctaagatctgtgaggtatatagtgttatttgtcactctgcgtttaattgttcctgtatataggtgggttggaagtttctaagacttgaattgtatgtagttaaatataatgtaactctggtcctgctagaatgtaagttctgtaggtgcagatatttttgtctgttatgtttactactgtaccctcagggcttaccatgtaaaagttgttcaataaatactcatttaatgaatgaatgaattggggtattagtcgttaaaaatgaaaatctcaatttctaaagttttgccttttccagaaagtattataattgaaatcatacaatgtggagccttttcagactgacttctttcacttaataatatgcatttaagttttatccatgtctgtttagagcttgatagtttatttctttttagcacgtaataatattccattgtctgggtgtatctcagttttatctgttcacctactgaacaacatcttcattgcttccaaattttggtaattatgaataaaattactgtaaatgtgtgtgcaagtttttgtgtggacattagtttcaaatcctttgggtaaatatcaaggaacacaattagtgaatcttatggtgagagtatgtttagttttgtcaaaaaccaccaaacagtcttcaaaagtgtctgtaatattttgcattcccaccagcaatggttaagagttcctgttgttccaaacatcctcacccagcatttagtgttgtcagtgttctgaattttggccattctaatagatgtgtagtaatatctaatttttttttaatttgcatttttctgatgacatatgatctggagcatcttttcatatgcttatttataatttctatgccttctttggtgatattttgttaaggtctttggtccactttttaatcaggttgttgattttttattgtttaaagagtttgttttacattttgagtaacagtcctttatcagatatgcctctacaaatattttcaccaattctgtggtttgtcttttcattctcttgatattaaaaatatcagagaatggacatttttaattttaatgaaacccaacttatcaattttttcttttatggagcatacctttgctgtcatatctgaaaagtaatcaccaaacccaaggtcatctagaatttcttttatgttatcttctaggatttttatagctttgcattttgcatttaggtctgtaatcaattttgagctaatttttatgaagagtataaagtctgtgccttgattgattgattttgcacataaatgtccagttgtttcaatcttatttgttaacaacactatctttctctattgtatttcctttgttcattgttaaagatcagttgactatatctatttctgggttctctgttctgtgtcaatgatttatttgtgtattctttttaccaataccacactgtcttggttactataactttacagtaagtcttgaaagcagatagtgtcagtctttcgactttatttttctccttcaatgtcgtgttggctattctgactcttttgcctctccatataagcttcagaatcaatttgtcaatatctacaaaataattttctgggattttgactgggattacattgaaattatagatcaagctgggaacacctgacatcttgacaatattaagtcctcttttccatgaatatggaatttttctccatttatttagttctttaatttctttcaacagaattttaaagttttcctcatataaagatattttgtgagatttgtactaagtatttcattttgggggatgctaatgtaaatggtattgtgtttttaatttcaaattacacctgtttgttgctggtatataggaaagtgattgacttttgcatattaaacttgtatcatgtaacctttctataatcccttattaattccaggtgtgtttttcagttaaatcttttggattttctacataatcatgccatttgagaacaaagagttttatttcttccttctcaatcagtatactttgcttttcttgtcttattccattagctaggacttccagtatgaacattgaaaaggagtggtgagaggcgacacccttgcattgtttttgatcttagtgggaaagcttctagtttctcatcactaaatataatgtgagctgtaggtgttttgtacattttaaaatcaagttgtacattttaaaatcaatttctagtttactaagtgtttaatcataaatggatgttggattttattgaatgctttttctgcatctactcatatgatcatatgatttttctttagcttgtggatatgatgaattatattaattgattttcaaatattgaatcagcattgcataccttggataaatccctcttgattatagtgcataattctttttatacactgaatttgattggataatttcttgttgaggatttttgcctctaagttcatgagagatattggtctgtagatttgttttcttgtaatgtctttgtctggttttgtatttgggtggtgctggacttattaaatgagttaagaagtatttcttcagcttttgtcttctaaaagagattgtaaagaattgatataacttcttccttaaacatttgatagaattcaccggtgaacccattgaagcctggtgctttctgttagggaagctattaatgattgtgtcaattgctttaatagatatcggcctatttaaaatgtctgtgtcttcatatgcaagttttggcagagtgtgtcttccaaagaattggtccgtttcatctgttattaaatttgtgagcattgagttgtacacaatcttcctttattatactttcaatgtacatgggatctgtagcatgtactaatattaaaaatgaaaggacatcatttttaatattagtagtttgtatccattctctttatcttcttttttttaaaattagcctggctagaggattatcattttaattatcttttcaaagaatcagcttttgattgaattgatttttctctactgatttcatgtttttaatgttattgatttctgctttaatgtttattatctcttttctgttgcttacttgggtttaatttgctctcctttttctcatttactaaggtagaagcttagataattgattttagatcttttaaaattttctaatatatacattcaatatatgcattcaatgctgtaaacttctctcttatgtctgctttgactgtattccaacaattttggtaagttgtgtttttgttttcactcattttatttagttcaaaatattttaaaatttatcttgagatttcttctttgatccctgtgttatttaggaatgtattgtttaatctccatgtattttgggattttctagttatctttctgttattgaattttagtttaatttcattgtgatctgagagcagactttttataatttatatttttaaaaatgtgttatagtatattctatgacccagcatgtggcatatctttgtgagtgtttcatgtgagttggagaagaatgtgtgttctgctgttgttggatgaagaaatctatagatgtgaattttttctggttcacttgtggtggtggtgaattcaactatgtcctttctgattttctgcctgctggatctattcatttctaatataagggtgttgaagtctccaaccataataatggattcatctatttctctttgcagttctgtcagtttttgcttaatgtattttgatgctctgttattaggcacgtagataaagattattatgtcttcttggagaattgacttctttatcattgtgcaatgtctctctttatccttggtaactttcatgcattgtagcctgccctgtctgaaataatatagccactgtcttagtttattttatgtttctataacagaatacctgacactaggtaatttataaagaaaacaggtttatttagctcatggttctacaagatgggaagtacaagaagcatagcagcagcatctgctggctttgggtgagggctttctgtgtaaaagttttttgtgctgtgccataacacgatggagaatgtcagtggggaagctgacacataggaagaggcaaaacccaagaggcatcctggctctgtaaacccactcttatgggaaatcattcattcctgtgagaattaatccagtctcaccagaatgagaactcaatcactactgcaaaaacagcaccaagtcagccatgaaagcagaagcctcatgacccaaacacttcccactaagtcccatctcctaacaccacctcattggggatcaaatttcaacaaagttttggtgaagacaaaacaaaccatatccagaccacagcagtcacacccactttcttttaaataatattagcatagtatatttttctccatttatttttaatctgtgggtatctgtgtatttacagttggtttcttgtaaacaacatctagttgggtcttgttttttatccactctgacaatccctgtcttttgattggtatatttagaccattgttgctcaaagtgattgttggtatactttcattaatatgtaccatatttgttactatttctatttactgtttatgttctttgttcctatttttgtctgtgactctttttctgccttgtggttttaatgatacatattttataattcaattctctctcctttctttagcacgctatactaaagacttattttataacttatttagtggttatacttcttttttcacttatttagtggttattctagagtttgcaatacacattcacaattaatcaagccaaattttaaataacaatataccactttatgggtactgtgagtaacttacaataacaaaacaatactaatttcttcctcccatcctttctatcatttctctagtgaaatttacttatatataagcaaaaataagtattagatatcctatatatggtaatatgagcatatgtaattgatatgttgttacttttattttgaataaattgttttctgttaaatcaatgaagaataaaaaaacaaaaatttttattttaccctcacttagtttttcttcaatccttgtcttttcttaatagatctttttaaatagagtttctgacccatatttcttctctctaaagaacttttaacacttctttaaggcatgtttgctgactaattccctcagtttgtggttgagaaaaactttatttcttcttcactttaaagaataattttgcagactacaaaaatctacacttctgttttttctttcaacccttcaaatatttcatttctctctcttttttgcttgtgtagtttctgaagggaagttggtataattcttatctttgctcctttgcaggtaaggtgtcttttccttctaacttctttcacgactttatctttccttttctgtagtttgaaaatgatgtgcctaggtgtaggcatttttttcttttctttttaattctgcttggtgttttctgacctttctggatctgtggtttggtgtctgacattaatttgaatgaaatttgcagtcattttctgtttgttaattccagcattcctgacatgtctgtttctgatgcttgctctgacttttcaaactatgtgttttgtcttttagtatgccttgtaatttttgcttgcaaaccagacattatgtactgggtaaaaggaactgctgtaaaaagatcttaataaggtggtggcagagtgtgagaagaggggaagtgtcctatgattgggtttcaggattttagtaagcctatgctctgtactgtgaacttcatgtttttcagtttttttccttcccccttgggtgatcagagtgagctggaattggtatttatcttttctcacatgcaaaacttgagctgactgaagttgggtactgtcctttccccatgccagttaggctctgataaaaccccatcaagttaggctctaggtaatgagtttctcctaatggtatacttggttaagaacatagtgttctggtatatttcaaaatggttgcttttctccctctcctggttggaagcaccaggagatttctccaatattcactgtgagaacctggttgagttcctggaggttaaagtcacaaaaatgtcaaaggccccccccaccccccatgaccacatccccttgtagtttttagctctcagacttgtctacaccaacccttcagcaattcattgattacagtaaaggttttcctacctagcacttgttgctgggagctttttgccctggtatattgtgattctctgtatccacctatctgtctttccaattctggggacaggattttgccctgtgacctcatctgttttatggacctaaaattagtttgtgatttttccattcgttgagctttttacttgttgtttgggtgaagtggcaacttccaagcttctaagatgtggaacatgaatccagaagttcctttctatttttgatttctactctcctttgggctggcttaattcttaggaacttttcatctggtagcagagatgatcatgggaaagccccccacttacactggccttttggttagcaaccccagaaaaattagtttaaccttccaacccctttgtccacagaatttccaaaagtgattgattgttcttctttgatgatgtgctcagctgtggaccaacagttgtgtcctgagggagggagggagggaagggatttttttatagatagttctgaatcacgtgcctttgcagaggcgaagaaggcataagcaggattggcagcccatgggactcatatggagtgaaaatggggctaatcccaaaagaaaggagagattaaaagcaacaatcacaaatgttcaaatattcactatattgtatctaacaggcttcccatatagagctctaacttattttaatggtgaaatttttcaactccctttacggggaaactgaaattctcaaggctgaagtgatttgctcaaggtcatccagcgagttaatgactaatctatgagataacaaagatatacagttacctagtctacagcctgttctcactgtatcatttggcctcccagatgtcctataaacccacttcctttttttcccttttacatcaagcataactattcccatttagtaaatcatatcctattatagaattataaagtagattggccaattgcagatctacatacagtgtaaaactgaccttgaatgtaatgtgttggaattccataacccaggtaagcccgagaaaatgaaccatgacttttaatagcactgcaccacaaggattatctgaggatgtcttttaatgtattctataagacaaaggtgatttttaggcatcacacctttccagagatgatttaaattcattcaataacaagggtttgtgctttatgagctgaaactcttagtcgataaacccattggaaatcattacaagcactgaggtcctggttatgttcatttcagaacccctcttaacagtgtctcttttgcagccagtatacacggtgatattctagatcttgtcctcacaactttatgaagaagaaaatgactacgaggggatatgaggaatgaaaaagaacatagggccaggtgtccatcaggactctgtgaccctaaggaaggcacaaattctctcggtcccactttccacattggtgaaatgtggatatttagagctcaaaagcggagagattctgacagtatttgatagctatgttactacaatgcgacaaaagtggactgagcacgaccttcaactcctgaagactagaaaacgtccctagatgatctttccttcaactactacatttgtttgcaattggcatgaatttccatagaaatagactattaataaagtacaaataagtagaagcggtgtcccagaaaaccaacattgtcattcacctaaggatggaagaaggaaaaagaacaattagtcacaaaattggtcttctttacactaatatgaaaatatattaggtagcaaaatatttacataaaaaagggaaaagttaaattttatatggattttctcttcagttaactgagctttcaggagatgtgcaaaaatactcagtggttataatgcattagaatttattgcagtagaaatgaaagtatagtcaccatgacatagtcacccccgattaaagatataacctaaaattcctttatcgttccatgtgtcatgtggagattaaaatgatttttaagtgtttttattctttttttgtgtgcttcattttaaaaaccacagatttacacataaaaaaccagcagtctttggtgaatgctaaagaatttgggggtaggttttaaactatgtcaatattatgaaatagtttgaaagagatatattatgtgtttattaaggggatggaatgatggccgatttgaatttacttctatatcaatgtagacaatctgatactttgtcagaaaaaaaagaatatgtagaataacaaccaatggcaaacagataatagcatgttgacagccttaaaatgagatagatgttttcttttttctctctttaatatgtctctgatttgtcataaaataccataaaatattgtcacctacatggtgatattgttactcatgttttataaaaaatataatagttcccaaatgatattattgaggtctctttcagttatggatataaaaatcaatttaaacggcttaagtaaaaaagaggatttactgacacccatatgagaataaaaaataatgatgtcatggcttcaggcacagttggattcatttattcaatgtcaccataaattacactttctctctgagctctgctctcatttggattggtcatatctggcaaaatatttctgtgtgcagacaagagagcgacccctagcttctgattcacattctatcatcttaattaccttaagcccaagataacttttttccaagtgcttccgagcaaagtgttgtagttgtacctcattggactaacttggactgcatgcccagttaccctagcccggagaaagaaatatgctgattggctagacctagtcacatgatctccacagatgctaggagctgaggttaatcacccccacagcacagtgatgaagagtagaaatgacttgacactccccaaagtggtaaggtgtttttaccaagaaggtggtgtaattcaacatcaaaaagttccctaaatattatatatgtagtaaactaaatgtttgaagtcagagttaataatatcaacttgcctggtaaggactaccctgaatattatcaaattgaatgatgaatagtttttagaaagcagtatttttcagccctatattagcaaaaaatggagatactgctttctattgactaatatggagtgacattttggtaaccaagacccataaagttactgttttctgaaattttcttattcttgaagcagagcctcaagatcctacacattatgctttttaagtgttttccagattaaatgatatcaaaatatcgtagttaattggtgctatttttatagaccatcagaaaaattcataaaagtgaaaaatatgaccacatgttacctgtgcagtagagtattgtctaaccactggattgactatttttaaaattttgttagtgaagtgagaaacttcacagagtagacagtgatcatgagtgtgtcatgtcagttcgcagagccccacctcagacttacacaatctgaaactctgagggtaagtctagcagtcactgtttaatcaagcctaccacaggattctgatgcatactaagatttaagaactaccaaatgagcattgacacacagtttgttgtcaacaattttacagcaataaaaatttcattaaaatatctattctgatagtacttgcactagtaatagtagttgtagtaattactaatgtttattaatcccttactatatgtcaggcactgcatatctcagttgatgaccacaactctagaaattagatgcccttgttattcccattttttgaaagagaaaattgaggatgaaaacaaagtgcttagtcaaggccacacagtaaataaagaacgcttccttttattaatcaccagtctcattctataattttggcaattggaaaagtaccttctgcaggtagcaatggagtaacaatagactcagagacttagaaacaggaagacccttcactgttttgctttacattcatttgaatgtaaaccctgtctgtttatatttttcattgtatgaaaaaagagaagatgaggttattttttaaaaaccttacagtatttttcttgataagatgtaatcactgctgtatgaaggatatggacgtttggaagctattccttccttctgcctatgatccatgcaccagtacaaacctggtcattttatttcaataacatgcagcatcagcagagtccattgtgcgtttatagccttagagctcgtcgtgttgattggagtcgtgttttagccaggttcctatttctttcagctaagtagttacagcaagctgtaacttcatgcgacaagcctggacatagcttttccttttggccccaagaaacttctgggatgcattttctgtgtatgtagggtcccaccagatttaagaaaagaaatgactcatttttccaccactgcatttttgtagtctggcttatgtcaccaatcaggacaaggctactcaatctggcttcttccattaagggactggctctaacatagagccttctggtttttgaaccaaactcagatccagcaaggcctcattctcattttggcaagaaagtaaggccagttggcctgaacaatattttaacctctatcttttcagggccccagggatttcatctccccacaggaaaaaaaaggaccaagccaggccttcaggttgtttgcatatgcctgtagctcaggctgccctgctgtgcagaatttcctccaagttgtatgcttgggtggtaggcatggatctaagatgcccccaaggttctcactacttagtgtgctctgaataagcgcctcctcttgagtgtgtgcaggcctggcctaattaggtgagccctttaaaaaacaggtgtaatggaagagacaaaatgtctaagaaattccacactgcagagatgtcctctctcttgccttggaggaacaactgccatttcatggatggggccacatggaaagggcctgcgagtaacctctgggtgccaagagggaaacccacccaatgactagcaaaaaaatgggatgattggccatacaactgcaaggaaatgaattctgccagcaacctgaggggttcagaagcacatcttcacttagtcagtcaagcctccacatgagaacacagccagctgacagattaatttcagccctgtgagaccttgagcagaggacccagctaaaacatgccagcctcctgatacacagaaacagtgcagtgacaaatttgtgttgttttaagccactagatctgtggtgatttttaaattcagcaatagaaaactaatacagcctggaacatgcctaaccttccatgcagaatattacattatacagcagtaatttccaagactgttagataaaaaatggataatgtggctctataacaaatggaaagcaacatagaaatgttgtgattcttgtagacaattaagttaagagggtagcatatcgtattatcattgtcccttcttgcttcttaaccagtttatttgctgtctcccacatgcattattacattatatgtgttctcagcagtttcagcctgtgattttctggcttccaatgtgtttagacattgactcaaaattgcagtcataggttttgcttttttaaattgttaaaatgctatcattctatcaacaaatactacaacattactaaaactttttttcattatattgttcatgtttgctgttaagttagggaacttatttttttctcattttgtaatacaaatacagctataataagaggcataaaacccacacaatttatatatacttcattgtctcagattgaaaatcaaaaatacatagttcaaatctatagatgtggagcccgtagtagctgaaattgtgggcctatattttaaactcatcagcatcacttttaattttttttcctaaacacagttaaacatggtctgaaagtgccaaactccatcacaatttttttcccctttttcctggcccgggtttgtaatgagcttgtgtttgagagaaagagaaaaggagaaaataattggaactgtctctcgttaccactaactcctgtttttgaaggtttttctattgtttaacaccttccatttgttttaccttagaagcgtgattcagttatcaaaacctgaagaaaatgaaatctaacttataaggcttcatcataaatatggtgactcaagtcaggaaaaccaagctgtctgaaggcctggattttagattttcctctgaaatgaaagttggccctacagatgcctctggggaccatcctgacaggccaggtattctcaccatggttatcagtgtgaatacacataagctcttgtgatcaagggctttgctagctgctcatccattaggtaaagtctggtgggtatagacttgggacttactaccaaagggatcatatcctccaggattacctgactcactgaatcatctcaaagttccaatgtttacccttcagtctagcataatgaagggaatctgttttgatgtgcaatacacaatgtctcaatttctcagagctgagaaagactataaatattcaacagtcttttgcctaacacgtgtacccattcttcccaagctctattcagtaagccaccctactgttgctgctactactgatgcagctcctgctgctagttaacctttttgtaatgtttactatgttccacacacttggaggtagtatattggttatctattaccacataacatataaactccaaaactgagcagctaaaacaagattgatgatctcacacagtttccagtactggctttgttgggtggttccagctgtggtcattgtctcatgatgttgtaattcaaatattgcctgtggctacaggcatctgtaagctttatgggactggaagacccagtgctaagacaacccacacacttaacttgcaaggagatgctggctattgaaaggagacctttgtcccttatcatttggacttctttatggggctgctagagtctcttcacaacttggcagctagcctcccccaagcgagtgatccaagagagaacaaggcagccttagctgtgtattttatgacctagcctcgaaatcatgcaccatcatttctacaatatcttatcggctatgcaggttagtttcattcagtgtgggggaagactgcacaagggcatgaataccaggtggcaataatcactggtgcccatcttggaggctccaatatgtaggtataacacataatttatacttacaaagtgtatattctatatgctattctcaactattaaatcattttcctggtgtgaaggatatatttaagagagaagattctaaacatactgactaatgccttcattttcataatgattccgtctgaatttggatatttgaaaatatttactgacattctaccatctgctagtcacccttctgggtaccaaaaatactgtggtgattgagatagacagaatgacagccctcatgaagcatatagtctagagtggagaaactctgttttagtccatttgtgttgctataaaggaatacttgagactgggtaatttataaagaaaagaggtttatttggctcacagttctccaggctgcataagcagcatggtgctggcatctggtgaaggcctcaggctgcttccactcatggcagaaggtgaagggagctggtgtgtgcagagatccataaagagaggtgaggcaagagagagataagaaagttgccaggctctttttaacaaccaccttttatgggaactaacagagcaagaactctggccattgttcacagtgacacagcaccaagccgtttatgaggaatccaccctcatgatcaacaactctctttaggtcccacctccaacagtgggaatgacattttaacattaggcttggagggtcaaatatccaaactatatagcaaactctaatcaagtaaatagactgccatgagcttcataataaagataaaagcattgagatggaaaataagtggtaagtggaggttacctaggatagggtagccacagtgggctttcctgaagagacagcatttgactcaagaacaacagcctgagtatgagcctgtaatatgaagacgggaagctgcttggggagaggaggggcaaatcagaccaggaaagagactggtctgttcaagacccgaaaaaaaaaaaattagtgtggctgaagcaaagtggagaggagaggggtaagagatgagattgtaatgagagaaaaaggccagatcacatagtgctctgtgagtcacttctaaatttaatggcagccattgagaagtttttagtagagaagcagcatgatattctttgtgttttgggatgctcagtcttgctactagttaaaaaatagagggtcagtttcagctgctattatctttgttcccctttttgtctccttataggtccggatgactttggctttcaaatgagacatcttccccctgcaatgagcagtcacttttctttcctcccactaaacattattaaaaccatgaatcactcatacagtataagtgtgtatccattcacctttttattacattttctcagcttttatcccctttcagaattgtactttacctgaaattccttttcttggtgttatccatacaatatgccaatcagttttttaaaagtatgtctaaataaggccagccaaggtgaaaagttgaggcaatggtggtcagagttggagaaaggggatggttgccatggaattattcatccctgacccatgtgcgatctttacttggtgctgcactgacacactcagctatgtggttgaatcacacactaagctgctgggtgggattgtagcccacggtcccagccaaaggaggaaaagtcatctttagaaactctcaggatatgccacattccctcgcgttaaccctcctctgggcccagctaacttaacttacaaatggtggtatttttttttttttaatcattttagagagagtaaaaacataacacaggtagtgaggttattagctcctctgcacttcaacagaagtcagtagttgattctgttggatgatataatcggttataacactttgttgccagtaaaaaagaaaccaactccagctaatgtaagtggaaactgaatttattggatgactaccaagagacttgaaaaattgaaggaaatgttggaaaaataactttaaaagggaaaaatcaaactgtgtccataatttaagacatagcacccagatctagctcatagtctcttcaagttgtcacttctggaatgaatgaatgtcatcgttattttcttgttgtcttttttcccttttgcatccttctgcttaatattaaaaatctcaaaagagagctcattgatctggcttggctgtatgtagttaagagaagtaatatcccaggaggaaatcagagtgctattaccaaaagtgataccttccctttactttcatgtattcttcccccaagctccctgtggagtcagggggtagggcctggagtatatgaaagatattagatcttcggagaaatgtcatcaagactgtgtggattccataaattccacacccagccaggaagatgcacaccttacgtgttccaagtaattttatcagtatattacaataaatcacatgccacatctttctgcataatgacctccagtttagtaattgcactcacagtaaatgtctgtgatcagaaagtgtacccagcttagaacttcttaccattggagccagtgggaaagttctgcttaaagccagtagagcctttagcacattcttccaatattgaatcaattcaaccttgactttcataaaaagttatttgatttttgcctgccttaacctcagatggttattatacacacaaaaaaagactatatacagaagagttaactacaaagtaggcaatatggttcccaatattacctatgtatatatgtgtctactgcagtatgccactgggctgtgtcaaagctgtttctcagttaattttgagtaccctagtaaaacacattagtattggtttcttggatttgcttgttagaaggaatggatcagctgggatattggtcttttccttgacatacatcaacaactcttgacactcaacatggtccaaatgctttgtctgtccttttcatgctttctagttatcatagaattcaggcatttccttaatttgccaagcacacttgaaacaatgttatttccttattaaaccaatcaggaattgatctctgagtatagaagctgtgatgctttgatactctcctggccacatggcatagatacagcttttaatatagtcttctaaaattctcccattcaatttcttaggtactataaggcctttccctttgcacaaaatttggtgtgattaagttctggccacctaactctgtgatttctattggttggaggagcatagtgttcgagagctcaggttcctggttcacagagaccagagttcacactctcatgccgtttctttctcactgtgtgactttgagcaagttccttagtttttctgggcttctatttcctggttttcagataaatataataataataaatgaggttaagtaggatattatgtgctaaattcttgattctgtgtctaacacaaagagctcacaaaatgttaacagttatcatcagcaactgcagtttgccctttcaaactacctcctcttacatatactgtatttggttattcattacattcaaaggagaatttattgtccctgttttttaaataatacacatcaattttttttaagtgggaagaaaagagagaccccactgagtgagtggggagttccccacaattttagtccaagtgtcttaataagaaagaaagttgcacttttgcttagaggttgtatatactgttgctgatctgtgaaatgaaggacactcagatttctgcattatttaatcatatcaatataaagctccataaaactactttaaattcaatgaagcatcattagcccagtatgctaaggaggtttcactgtgaatttatgcggttataactgaaatcaaaacctgacataatgtatatgcctaagaggaataataagaacaataataataaatagatcatactcaatatatgccaagcactttccatgcattattctatttaatcttcacactaagcagtgtggtgcttaagaagcataaaaatgtggtgagagtacaggatttggaggtcagacaatctaagctgaaatttaggctatgtggcctttgcccagttaatcttcacgtcccaatttttccatctgaaaaaataaagtatataatttctgaaaaatggaaggttagagaaaatctaggtaatcttgcttggatttggtgacaagtctttagatacaacacctaaagcatgactcatgaaagaaaatatcaataaactagacttcattaaaaattacaaacttctgctctgtgaaagatattgttaagagaatgaaaagacaagccatgactggggagaaaatatgtgcaaaatacatttctgataagggacgatgagccattagaatgacaaaaatcttaaaaactggcaatactaaatgctgacaagaatgtggaacaacaggacctcattgttgatggaaataaagaatggtatagctactttagaagacagttcggcagtttcttacaaagctaaacataatcttaccctatgatccagcagtcacactcctagctatttacccaactgatttgaaagcctatgtccacacaataaccctcacacacatgttcatagtggctttattcataaacatcccaaactgtaaacaaccaagatgtccttcaatcagtgaattgataaacaaactgtggtacactcatccagtggaatgttattcagccaaaaagataaatgagctatcaagccatagagagacatggaggaaacttaaatgcatgttactaagtaaaagaagccaatctgaaaaggctacctactctattattccaaccacaaaacattctggaaaaggcaaaacttcagagaaagtaaaaagattagtggttgccagaagttcaggaggaggcaaggttgaataggtggagcagagaagatttttttaaagcagaaaaactgctctgtacgatagtctaattgtggacatatgacaaaacgcatttgtcaaaacccattgaacttgaatgcacatacaatggaccttaatgtttgcagatttttaaaaaccgttttcaagaacaggggaatcccagatgaatgcagaatatgactaaaaatcctaattctattaaaatatataaaacaccttcactgaaggcagtgggggaaaacaatgctgactttagtaattttggaaatgtgtagtctgtaaaattaaaggaaaataagactgtgcataagcactgagattgggttgataaagttgtattccacaaaagcatgggttaaatgtgtatatatgcggcattgttatacacgtatatttccttgacatagcagtgagcacacttagtgcccagatcatagtttccaatagtatgactcaattgtaaagaccagagatttttggaaaattggataattctaggaatgggacaggaaatacataagatgagtctggagcatcttgtagtaccagtaagcaagaaaaggctcaaaaaagacatcactccataatcgcagagtcaaagggacacgggaaccaactgaagagctcccaagagccagcactggagcaatgagcaacaaaatgaataaagtgatatgggattataagccaaagtacaaaataaatatccattggctttactgatataaagaaatgatcgaataaataaatggaggagaaaagacaaatctaccatgcaggagaattccaaataatttagattgaaaatctaccctcaaggagggagagcacaactctctgccctttaagtatgaattctgcattgtgactttcttctgaagtgtaaaggatggaaaagtgagtgaggggaagaataactttccaatagagaaacctggcaaagattaccacagccaagttaacacaaacaaaagtaattgcagttttcaccattattcttaatgtaatttattaattacttttaatggcaaaaactgcaatttcttttgcaccaacctaatattatctacccttgatatagtgaaataaaaatcatagtttatctctgtggtcttcctcccccaaacccataatcccagtctaattatggaaaaaaatcagataaatataaattgagcaatgttctataagttatctgaccagtacttctcaaaactatcaaggtcataaaaaacaagaaaaagtttgagaaactgtcacagccaagaagactaaagagacagatggctcaattatcctggatggatgggatcctagaacaggggaataaaacaggacattaagttaaaactaaggcaatctgaataaagcatggactttatttagttaataatatattgaaattgaatcattaattgtaagaagtgtaccatactaatactaatgtaagacattaataatagaggaaactgctgtgtggggatataggaactctgtactcttcataatttttctataaatctaatactgctctaaaatattttattaaatttgagggttagtatgacaattaagataacgtgtttttcaaaccctttatatgtattgatttatttcattcttacaaagacaatctgagatagcacacttactatctcatttagctttcacagtaaatttattttttcttgcctaatgttagattttattatcatcattattataattgaagggtatttagatttgaataaaataaatacctttaaaggtttagaggaacctctgaaattatatactaaatgccatatgctgtgtgccttcctgggaagagcatctgaagcacttcttatgtcttcagatctttatgacaaatggatctttacacaatatgtttcctggagatttaattggcatcccacatgatttgatgtttcaattttccaggattaattcaatgtagaaaattccagcctctcaggtcacagttacagaaattcgatgaaaggtcccaagattttcatttctttgtatttaaatagatgttgatttcagatttttttctcaacatcgactggcaaacagctttaagaaataaatgatgctctaaagtctccatttttatagcatgttttgatgtaatgatgtacttagaaggatcaaatgtaatttcttaatatgtaggttaattaattacagcttttaaaagagagtatattcttattcatgataatccagatttctggcttgtgactgattcccaggtcacggtatggggatgaggaatgagtcgatggggcgtcagtctcacagtcatcaccactccattgtgtctttatatctcatatctttatgtctgtttgtatttcatacctggtcctacaggtatccagtctatgaaagttaataccagtaactgctaccttcaaatactggaaaagcatccagacagaagaaaggtagagcttcttctctggaatgccggaaaacaaaacttgtaagaaagatcaaaatttgcattgagttaaatttctgcttaattaacctgagaaacacattgacttgtgaggtgatgagatcattccttgctaccacccatgtagagaagagtctggacttgggttaagctgaataaatggccactgaatttccatcaagctccaagagaccatagtgttgtttctttgataactttagtttcttactatccgtgaccatcacaaatgtaacttcatttcatcttagctctgaatgtgaaatccttttgagtgtccttgatattgctgaaggatttctaaatagtactactcaattcctaagcattcttttttttttttgaaattattttaaaccaagatgttctctaaaaggatttataacttaccattagaaatcctcttcattgctttttagccttttaggattttgtagggattactaagaggatttctttttatcactagggaaatatggctacagctactatatcttaaaaaaaataaatcttaggcatagcttgacagtgagaaatgcatttatattcccctccagaacagtttccttataacccaaagacactttttaaaagtattttaatttgacaaaaactataacaaaataaaacctagagcagttagatctacttttgtatatagtttactaatatagacattattgaactgaatatcaaaatatagtttagaactcacagtgcttaaaaagtcatgttttagcactctgttaccctatcttttggccttttccaatgcagttgtgtataaacacaggtgtctttataaactctcattctagtttggcctctacatccaggcccatccaatcagctttcttgctggctgttggccagggatcactctcagcttctagaggcagcactcaaggggcccccttttctcacatagggctgtttgctttcttccaggccttccagagaacatgtctctgatgcttcaccttttaaacatttcacctgattgacatttatccaggataatcttgcttttcattaactcaaagtcaactgattagtaacctaatcaagggaatgatatctcattataatcacttttgctgcctacactcaagggaaagagattttacagggtgtatacacccaagttcagaaaccttgggagcatcttaaattctgcctgtcctggatgggtaccaagtttgtctcagcactggttatatgtttgcagattatagttagttgccagaaaaaaataggagaccttatccatattaggccaataaaaacaattgctagacaataatcagtaatcaatacaaaagaaggttttgtcctctccaatcctttgaggttttaatatgataaattggtttataagcttcataggtccccaattaattgtgtaagtcgaaatatgaactgtagagcatggattagacctttgaaacaaaacattcttaattagaaaagaatgtcacttagcttctaaattcatttggttcattaactcaagatgtgaaatttatatgatcactgagatagatgtcctcaaatactttttaattttgtaacaaagatatataaagattgtctgcaaaacaaggctgaatgaagccagttctaaagtgagctctcatggaacttagatgagaaagtgattaattcaagctgaataaaatctcacagataagggggcatttatgctgagcctggaataaaagcaggctcacaactttagcacatattacaactttagtgtgcagttcttttaatttgtctacaattaatatggtcttatttctccctaagttctttagacctactcattagtgaagagaagaaaaaaaaaaactactgatggatgtccattccgatttacagctctgtccaatctgtcagttcaaacaatttcttcggaaggagtttactatcttatacaaaatgatcagtatctcagatttccatcaccacctccaagatactctacaaaatgccatcaggtgtgtgggtaaaggagtttggctctctcagtctctgtggagaagatggattgtggtctttgggtcacagtgttctttggctcatgttcactgagtaatattccttcatcattttcttgctgcactgctgtctctaagggtcactcacagtattcttgagtagatctctttcagcatccctcggtgcatggttctccctatcagactcatcctcagattgtccccactggcaccacagatgcctctgaggattggctgtgatctccatcaagacctggctgaactgggttgctttatgttcccagaaacagaatgatcttacttctgttacagcacccctgtagaagcctccaaccacatccttagcagcttcaagtcccacgggtcacacaagtgtagctcagggaagtaaagcctcaagacttccctctggccactcctctgcttcaccatggcctcccactggtgcaggaagtggcctgtagaccattttggtccagtaacaaatactcttttgtggacttcagtattactgttgctcatctaattaacttttcttactggactttgacctaggataaagaaaactgggacccaattttgctcttcttcccttctcttttctccttcccattatttcttagggtctaaaaagggggggatgggtttgcccctattcctcctcttatctggatcttccctacatacaactctgataagagagtagattggctcttgatatattaaatgagaaatacaacaacttagataatattttcttaagcaaatagggtggcttgtaaggtgcctgttttgcaacaatatcatttttttaaatgtcacagacaaaaagttacctttctcccaatattgtttctgttcctaaattcctaatattcctcctctttcaccctcaaacagatggatacactagaacaactggggtaaaatttccaaaaagtcagaaagtgaaaagagaaaaagcatttttatgttttgaaaatcatttcaaacaaggttcaatagtattgcaactagcagggtatctaggtacagagaatagaatgagcaaatgtactgtgggggagattctcaatgaatatgatctataataaatatgatttgattgtgctatttgattcttttaatcccttcagagacaccactaacaatcacattttgcaaaataatttgaacacaaaaattggatacttatttgtgaaatagaatgaaaatccatggtgtatttgttgaacactgaaatataatagggaatggcacctggaaggtgttttggggtcaactgtggagagcttactccctcaagatgaataactgttggatctgagcagaccaaaaatcctctaactttttcattttattatactttcataattctattgaggatgagaggagtagaagagaaagccttacttatttatgatcatggttctgatttacaagttaaacgttaacacatgcaatgccacccatttttagaagaacaaaaccaagcctaaaaacagttgatgtagtttgtcttgccctttagcgcaaacttcatctgatgtcattgccgttaggttattgttcctttcacaagatgaattttatgccagacaggaaagcactatattgtccttcctatttcctcctctgatatatctttatttgcagagttaaaagtaaggaaataagaattggtcttttacctgcttgtctctgacattttctgagttgtatgaagagtgagaccatttttcttcatatatccccctcctcttgccttcagggttactagcttagttatgtttctacttggcaggtattcaatatctatttgatcaataaatttggttgaattaacttctcaagtttatttgtacaggatctttattccatctcaatgtggcagattaaacatattttctaatggaggatcatcaaccatacttcttaatatgtctgtttttggggagggtggagagtattgtttttatttttattatttttatttatttatttgtttattttgagatggagtctcactctgtcaccaggctggaatgctgtggtgtgattttggctcacaggttcaagcgattctcctgtctcaacctcccaagtagctgggattacaggcgcctgccactatacccagttaatttttgtatttttagtagagatggggttttaccatcttggccaggctggtctcgaactcctgacctcaagcgatccacccaccttagcctcccaaagtgctagtgctgggattatagacatgagccactgtgcctggccagtattgttttttaaaatatcactttctattgaacattcttcattatggcatttttttcccacaaatatgacaatgctttgaggcttgatttcttttttggaagaaagcaagtctttcagagccaagtttggtgacttaggtaggtattcagagtgggtgaacatctttcctgtcaaaataatcagtgtgatttccttgagggcctattaaatgattatttagacacttccaacatacttaaggttgagatcgcttattaaacttctcaatatttccacttatacttgaaaggaaatctctgccaataagcaagctggagttgtcgttcaaaatcgtctttcaataaatgagcacttactatgtttcagattctatgttaaatactttatatacaccgtgttattcaatagtatcactgaatatttacaacaagttaactaagtcatagaaataaaactaacttaaaacaatttctaatttttttcagaatatgtgtgtgtgtatatatgtatgtatgtgtctacgcctgtatgtacataagcctgttaggaccatttttttttttttattatcaccatgtccttctaataaaaatgtaagccttcccagaattttacctacagagaggcacaatatgcaactgtgggaaaccctccaagccttggaagtcaaacacttagcaactcaagggattattccccatgttcactgttgggataaggaaatttagacaagtggcagggtcttttcagtagtggctatgtattcagggccatgatgaatgctgatcaggacaaaagtaatttatggcacacctgaagttattagcaatcttgggctgaaatctgtgactgatcaatgccttctgggaatcaccatgctttattttaatttctgcagttaaaactgaatgcaatgctatacagccatgtttatgtgactacctcaacatcaagtatatgaatttgactaaaccttaatccagattttttgtttatctagaatgcagttaatgagaataaaatttattgagcccagattttatagccaacaaccatgcaagtagagggaaactgctagtatttggtgggggtgggttatttcttcctccctgaatgatgttttctggtttgcttctcacagtcaacttaaaatgtaaaatattttagaaagatttaaatgcatgtatgaattgtctttggtaaataaaggtaaatgtaggcaaatttaagacatccttataagatagaataagactaagaagagtactgacatgcccttcaagtgggtgtcttccacctcagaactctgacctttcccctccacacacctgctgatttagcttttcttcaaggataaggggttacactgatctgtccactctgtagggcccaggctcagacagaggaaaacatagtcaattaataaattttaattctctgtttgtaaaatttttgcaacctattccgaagggcttctaatctcatcttagtctctgtggcaaactttttggctttctagaaatccagaaactagaggtttattaacctggagaattgtgtttgtttcctgaaagctttctagcctgtggcctttcatttgagggaccatacacagttggtagcaaaggtcactggacagagaggctagtgattagagtcaccctcctggttgaagctcataggctctcatttatggcagttcctttcattgctctgggcctcagtttccccatcttttaaattaggcaattacaccaaacaacttctaaaatacttttagctcatataaatagtcaataagagcaaaaggagattctagacttttagttggggagggggttacgagccaggaggtgtgggcctgtgattgcctcccttgctgtttgacttttccaaaacgtttggcttgtggcacttttttttttttttttttttttttttttttgagatggagtctcgctgtgtcacctaggctggagtacagtggtgggatctcagctcactgcaacctctgcctcccgggttcaagcaattcttctgcctcagcctcccgagtagctgggactacaggtgcacaccaccaggcatggctaatttttgtatttttagtagagacggggatttcaccatgttggccaggctggtcttcaactcctgacctcgtgatccacctgcctcggcctctcaaagtgcttggattacaggcatgagccaccacacctggctggctcatggcactttattacttgtttcagtgttagtttatttccctgtgtttaagcctagtgtactctcatgtcaagaggagacatgaatgggaagttttcaacaacctgcaatgtctaatcggaacttgtgcccatttattcgtagcaacttttatagggtcatctatttaaaataaatttacccacaccaaaggaatccatagagagcaacagtcaaaataaattacctaataattcctgcctgtggtggaaatatggtgccacagaaggaaggccagctggcaaccttggagaggtcatgtctcctctcatcttgtctgccctctctaccacaaggtgtggatactgatagtcgtaggaaatatgtatttcctgagcacttactatgtgccaggccctgagtcaggtacccaacatgcagagtaggtagccagagtggagtcagacttctcaggttcaagtcctgtctctattatttacttattataaaacgtcaggcaaggtatttcacttctctaagcttgaatttccacatcttaaattcttctttgtctttattcttacttggaaaattgtgtaatcttgagcatgttttttgaagtctctgagcctcagataacctatctgtgaaaatgaagcaataacaatatctctatctcaggtttgctgtaagcataaaaaaaaaaaaatccatatgaaaacactttgaaaaccatcaatatggagagataagattttgttatacataaatttatagcctgtagttgagacatgatgttaaagagtcatatttcacaaaacagaatattcctgcagcaggcagtcattagcagaattgaaattcaggtccaattttcagagttcagtttacttgttcaaagaaagaccgactgattgatggaaaagtgttgtgattttctcagtctcaagggtctgcctttcccactgttccttagagcttgatcagacaattaaaaacaaggggtcagggtataactgaaaataaaatgattttgtgccatatgccaatgctattcactcatgggcaggctgatatgctccaaagtgtctgatatgctttcatgcctattaacaaagggagagaaacaaccatattatcacaatcataggttttccaccactgtgcttcatgttcaaatgaatgactctcatgtttcttagggacatcattttatatgcatacgtgaattatcaattcaaaatatttacttgccctcctctccactccactctcacatactcccatgtctgtcatgccttttggtgaagttccaatataggagacacaagtggttaatgaaaataaaacttgagataaattctccttggcctcaaggacctaatctgaatggggagaggcagcctcatcattgcttgccctcctcttcttcatattaatgttcattgtgtaacacattttacaaggtactttcatgtatattatactacttaagactctcaaccaccctgagatgtaggcagagcatgaattattagctttcttttgaagtcagacaaatgaaagctcagaagtgatttggctcaagacagagaaccaatagttctcagagcctggtcacttcccagctgagcccccatcctgatgccagtgctttttctccctaccacatctgccaagcacaagcttgggaagacaaaacttgcaaaaggtagcaaccagcaatgagcgccaccaggaagctgactagcagttcagaggagtaaagggtacgtagccttggccgaggggttgtggggcacataagagaagctgatttggcctctgtcctctagagaacatttactattataagggagcccagatgcacacaaatgaaacaatgagctgctgaaagccaagagtcaagcagtcattgttactggggtggattccttaaacatctcaaaatgtctgtttttttttgttttttaacacaaggcaaatatttctagcatatgcaaatattcacataaaaatttgtatttctcgaatgtggattagcttgtatcctagcaatctctgtttaggtttcctctaacaggaatagaactaaaaataaatcatatgtcattagataatctcagagtacatccattaatttcctttcctgctaaaaagcaatgaaattatggtttgggctgtgttgagaacattacatgaaaaatgaggaaagggaatcaagacagattagaacataattatgtgggctggaattcagccagacccttcaaagccttgccaagttggtgacatcctatgtccatcctctaggtaaacctggaaaatgagtacttcaaactcaaaatgacactttccatgtagcaagtctccatacaggcatattggggaaaaactgaatcacaaaagaccacaaaatgcaaagggagaaattaagtgaaagactgaatagaagatggaaaatataatgctgaccacttatatattatggactagactgttggctttttttctcccaactatggtcagagatattaactttctctatacagatctggcttgaatccgtggtgaattcccaaacagggtgtgaatttatcactcaatattgggagcatctggggcttttcattttattaaaatgatttttttcccactacatgtgctccatggagcaaggtctgtacgttataagttaaaagtgattccccagaaggaaatcttttatcactggccgtaacttggagtggagcatatactttattttggaagctgccttgtggagaaaacagcccagggtgcaacttggagacaggttgacaagtgcataagtagcttgtagctgagccctcaggatggaaagatagaacacaggctgtttcggcagatgcatttgaggtttgctcatctgtgaaaactgggagaataaaagtacttactcattgagttatcatgaagagtaaacaagataatgcatggaaagcatcattacatcccctggcatattgtaagccctctataaatactgttctttttcctaatttttatatttttgtttattaatttgttttagagatggggtctggctatgctgcccaggctggagtgaagtggcttttacaggcacgattaaagcccattgcagccttgaattcccgctcaagctatcctcccatctcagcttcccaagtagctaggactgcaagtgcaagccaccatacctggcagacctctataaatatcaactgctatgtcaggcatgataatcaggctcaaaaatatttccgcagaaaatacattattactgtatattttctgttctagcagtaccatctggctgtgtacttttacttctttcatttactcctgctcgactgcttagttattgattttcttacttgtccatctctcctactatactatgaatgtttcaagaactaggtttattacctgttgtctctgtagtcttggtgcctagcacaaagtttagaatttactagttctcaatatatgcaagtttaatggacttaaaagaaacaattctttgcttcttagtaaaaccagctttgggaaatatgccaagactggaataaaaccacatctcatctggtgttgaacttgcaagtgaaacagatgagaatggcacccttcctccacctatattgagcccttgctcaaatacttaaggttaagtgaaggctgaaggaagaaatttgggagaaagcaggagaaaaaagggacactgggggagggatttaaagagcaaagattgctcttgaagaattcattctgcccaagatggttttccactcacttctctgattccctgaccacccaccatctgccccctccaaatatggcatctggctcgacttttaaaaaacaggaggcttcactttcatcaaattcaagaaatcttggctatggacttgtgatttttgaaccagataggcacaatagtcttagcagcattttgtgttggagtagatttggaagtcatagtgagtatttcctcactgattttcttcattggcagtcaagcagataactaagatctgctattgctctttctcatgtttttacaacgttcaaaaataagaattttacctctgtgaaataaacatatataacaaatccttatatgctaggtgaaaaagtagaaattcttgctaagatatcttattctaaaacagaaaaaatacctgctgctttactgtctaaaatgtcatcgctcaaccattttcactggtttgtggttgagatgggattttaaaaatcccaacataatcaaagtagtagcacaaggcactgttttgttttggagtgggcttttttttggcaaatgatgcaaaacacttttctaatgtagaaatgagaaatgtggaaacataggctggaactgtagcatggccaagatgattataacatagttgacgttttcttcacatggttaatcattactttttcgtaggtgggaagaagaaattagactaattaaattgtgatcattgtcatatgaacagctctcaatgtgcattcattggaatgaaatatagttgtcaattctttgatgtcagacctgtttcggattccagtttctctacttacatgtgtagtttaacccccttaaggctcagtttcttcatctatataacggagagatatataatgcttgcctcaaacagccgtttatgacaagtaaatgtgatgatgtatgtaaaatccttagaatagcacaggacctatggtgatggcttaataagtaacttttttttaatttttattttttacttttatggatacacaagagttgtacatgtacatggggtacatgggatattttagcacaagcatgcagtaagtaatgatccaatcagtataattgggatatccatcacctcaaacatttttgatttctttgtgttaggaacattccaattctagtcttctagttatttttaaatatacaacaaattattgttaactacagtcactctatgtgctaccaaacactagatcttattccatccaactatatttttgtacccataacaaacctctctttatccccccctgcaaccccccaatgaaccttccctgactctgataaccgtcattctattctatatctccatgagatcaattttttttaatcccacatataagtgaaaaatgtgccatgtttgtctttctgtgcctggcttatttcacttaacacaatgtcctccagttccatccatgttgttgcaaaagacaggatttcattctttttcatggctgaatagtatttcattgtgtatatgtaccacattttctttattcattcatctattgatgggcacttaggttgatttcatattttgactcttgtgaatagttctgcaataaacatgtgggtgcagatatctcttcaatatagtgattttccttcctttggatatacaatgagcaatgggattgctgaatcatatactacttctacttttaattttttgaggaacctccatactgttctccatagtgattgtgctaatttacattgtcaccaacagtgtatgagggttcctctttctccacatccttgtcagcatctgttatttattgtctttttgataaaagccaacttaactggggtgagacaatatcccattgtggttttcatttgcatttctctgatattagtgatgttgaatatttttatatctgttgaccatttgtatgtcttcttttgagaaatgaatgttcagatcttttgcccatttttcaaacagataaataactatttaattatcattcaatcattatttactgagtgccttctttaatcactagtcatatttagtgtatttttatcaaagacaatgaaggtttttatatgtttacattttttgtttatttaaatgcatgtgtatgttcctgtatttatacaggatatgcaaattgaaaggtccatcctttccaccaagcatagagatacaaatttttgtacacatgtattttttctgacattttattataaacatttaaatactcaaaaaggtagaaaattgaacaaatgaacaactcattaccaacacatagcttacacaattatccttttattatatttgctttaacacatatctgtcaatctacccatgctttaatctatttgatttttttttttttttttttttttttttgagacggagtctcgctctgtcgcccaggccggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagcgctgggattacaggcgtgagccaccgcgcccggccaatctatttgatttttgctaacagctttattgagatataatttatataccatagaatccacttgtcttaaaggtaaaatttaatgacttttaataaatttacagagggtgcagccaagtccacactcagctttagggcctttccatcatcccagaaaggttcctcgtgcccttttgcaattactgtctcttcttaaccttagcccaagtaactactaatatattttctgtctctatagactggaaaagccatacattttttccttttatttttagttgtgacccttaataattgtgcatatttataggatacagagtgatatttttgatgcaagtgtacagtatgcagtgataaatcagggtaatttgcatatctatcacctcagacatttatcatttctttgtgctgtgaacattcaaactctcttctagatacttgaaaataaacaataaataattattaactaaggtcaccctatactactataggacactgaacttattcctcctatctactgtcattttgtatatgttaatcaacctctccctatcctcctctccctgctactctcacaagcctctaataaccacaattctactctctacttttatatgctcaacttttttagctcccccatatgagtgagaacatgtggtatttatctttctgtgcctgatgtatttcacttaacataatgtcctccaggctcatattgccccatgtgacaggattttattctgttttatgtctgaatggtattccattgtgtatcacattttgtttatccgttcatctattgatgaacactttggttgcttctctattttggctattgtgaatagtgctgaaataaacatgggggtgcagatattcagtatactgattttctttcctttgcataagtaacacaatagcaggattgctggatcatatggtaattctatttttagtgggtttttttttctctttttttagtagctatgtcacccgggctggagtacattgatacaaccataactcactgtagtctcaaactcctggattcaagtgatcctcccaccttagcttcccaaatagctagcactacaggcacgcactaccacacctggctaatttttaatatttgtagagatgaggtctcgttacgtttctcagtctggtcttgaacacctggtcttgagtgatcctctctgtttggtccctcaaaatgctgggattacagacataagccactgcacctggcctatttttagttttttaaggaatctccatactgctttccataatggctctactaatttacattcccactaacaatatatgagttcccttttctctgcatccttgccagcatttgttaatttttgtctttttgatagtagctgttctaatgggataagatgatatctaattgtggttttgatttgcatttccctgataattagtgacattgagcattttttcatttatttgctggccttttgtatatcttttttgagaaatttctcttcagatactttgtccattttttaatgagtttatttaattttttttattttttgctgttgagttccttgtatattttggatattagttccttatttgataaatagtttgcaaatatcttatcccattctacagcttctctctactctgttgattgttttctttattgtacaaaagctttttagtctaatatagtttttcagtaccatttatggaagagaatgttctttcctcaatgtatgttcttggtgcttttgttgaaaatcagttgaagtaaatacatggatttatttctgggttttgtattctatttcattggcctatgtgtctgtttttatactaatgccatgctgtctgggttactatagctttgaagtcaggtcgtgtgatacctccagttttgtcctttttgctcaatgttgctttggctattcagggtatttcatggttttctacaaattttaggatttttttttctatttttgtgaagaatgtcattggtattttgacaagaattgcattgaatctgtagattgaaaaagccacacattcctaagcagcatgataataattcatgagtgcttttatactggaacttccaggataaaggtcttgaaactgtctataccagaaggaccttatttttttaatgaagcaaaggttatagggcttacatacatcttcttgcatcttttttgtctgtggtctcactccaatttttaatgtctagagcattaaataaattcccattttactgacaagaaaaaatgagggaaatatgaggaagaagaaaagaccgaaactggcagaaaagcaatggtaattgtggagttcaagccaggagatccctgttgttcatcactgctcactgctgagtctcgctttgctgaatatcaccgtacctccacaaaacataacgagatggaagaatacatacagattatccagcagctgatatttctgtgggttatcagctggggtggtgattgcttgaacagattccccactatggcatttgagagtgaaatcaaagaacagcagtggcaggtgtttggaaactgcatttggaattggcctcctacagaaagaagctagatactgacttcgtgggtgatgagagaagtcgacagcattctcagagggaagttgcttctatggcagctttccaagcacacagatttaggtttctttcacattaaatccctgaagatatatatagggcttgaggagcggggagcaacagggatgccaccttcatatgttgagtatctcctcttttggagataaaactgtcgatgctaacccgaaggagagtatttaggattcatcaactctgagtgcaatgaaagtataaaaaagcaccagttcatccaacatgctgtgcacccacagttcccatttttctatttccaaaaagattggtttctgagtcattcccaagtgacactgctccacttttcacctggctcaccaaagctctgcttggcctttcaagatagagtcgagtcatcactacccacattttcactcattggttagtttctcccacattttattctcggccttgagaagcaaagaaaccaacaaaaaaaccaatgtcattggtgtttgctgtaaatatacatagatttcctctgattacaaagtcactgaaaatcacataaaggcaaagtggcagagcaggtgacttttgattcaaacaatgtagtttgacatctatttgatacagctttctgtgaatccttggcagtgtacatgctcagtagagatccttgaatgaattagtgaggagcacagatgaactccattgtctgtaataaacgcttgactcattcctgacccctgcccccaccttgtatgcacacacgtttatatacacgtttgctggagttctgaaggtattgctcttagaggccaatatgcattttcacctcagttcaaggtgaaggggctgctctctaaggatcttaactattttatttcctcacatatggcaactttgtggagagactttgagttcagcgaattaggtagaaatcttattttattccaaccgatgaatttttttgagttaaacatctccactcaccatatcttaccacatctcacacattggttatgaaatccatcttagagattatgactaaatgaactgttgctcttcaggaggaataatttgtctctattatattgatagcagccttaacacctaccagttataaaattctgggcgtgttatttaattttttttcagcaccaaatgtctcatatgcaaataacatggaatgattctaagaaataggtggtattgtggggattaaaaattgcattccaggttcatacttcgctaaaataaataacagcttctgggaatggagaacttttgtttgtattggctcaatttctatttccagttttcccatagagtagctcatttttttctctggaggagtcattatgatctggttggtgcttatcctacccaatgctctgtagatcaagtatggctggccaatcaagtgttttgtgacccctggtagtccagtgagactcagacctggaaccttggtacatatattggtaaaaagaaactgtctttttgctggacttaaaactggccgagtgcaaacctggtgcttcagagaaccacttcacacatgaaaatttcttgagagtgaaaataaagcagaaaagagtagaactgagatatgggaaagagaaagatgaaatcttcctcacaaaggttgagtatctacgtggccaactctgaaatgagcaccattctagacttttccaccaagaggtgctctaaatattccttatttgtttaagctgatttgagttagcttttggcatctgcaactggaagtcgcaattaacttgtttctcattaatgtaattattgagagtaaaactaccacaacactacccacctgggtcactctaccttgttatacaaagttgatgctcaataaaggcagaacaccaaaagcctcatattcaagtaggacagaaccaaggaaaagggccactcataataaaggtggacattctgagccatttcattattcatacctctagtttcccaaggcatgctaggtaatattctaagctttttgttaaactcaaaaattattttggttatagctggatttcaatgattcatactttaaaaaatatatttccacaagccagtgcattcaaaatgaacttatgaattactatcattagtgagattaagaaatggcattctcatataggccaaaatacttggctaaagccacttaaactcattccctttcattattttataatgtactttgtgacagttattctaacaagatgcactgaaaggaggtactaatgaactgaacctattcaggagacagacgttcgctaaccaactgcatgatgggaaaaaaatgaaaggttgaggttgttgaaaaactctgttaacccgaatattccaattgcagtctttcatattcagagtgtgttaatatttttcatgggaaaatgtatttcttaaagtgggctttaattattcttgaaactaaatatccatttgaatgtccctgcctggtcatataaaaacagcttcatggaaggaagtcatcactgaaactgcttcctccaatttcctggccgagttatgttggctggagtagcaccttctcatgagatcataatcatggaatcctttgtggagaattattgacagcacatcaataagagctcataaaacatgtgctggaattaatggggcttcaacaaagatctcagacatgaattagctgttctaatgaaaattagattatgtttgctaaacactaagacattgaataatatctcaacatatgtaatgttacaacacaagatatacaagatacatcattgtcttaatctgttcaggctgctataaccaaataccataaactgggtgacttataaacaacagaaatgtatttctcaaggttctggagactggcaagtccatggtcaaagctctggcagattcagtgtctggtgaaggcctgccttctggttcacagatggtgtcttctcaatgtgatctcagtggtggaaggaacaaggcaactctctggggccttttccgtaaaggcactagtcacatttgtgagggcagagctctcatcacctaatcacctccccaaggtttcaccttctagtataatcaccttggaagttaggatttcaacatatgaatttggagggggtagggagggcttgggaggacacaaacattcagaccatagcaataacattcactgctgatgctcaagtagatagttgactcagttggtttttaatgctacgcacacatcaggtacaaatggataacaaggcatgtatgtatgaattcatgttttcatgaatttaactcctggcatcctgagggggtgacacaacttggaggcagattatctcaaagtaaccaatgtataatagggttctgaatttttttacctatacactttttgccttaaaattttattggtttttgttcaattacaaatatattccttattgttaaaaagtcaaagtgtattcaaagatgttgagttggtcagagcccaatcagaaatgaaaaatcacatagtaattgggatagaaagttgcatataaagattatgaactgtaataggagattagagtatcaagagattgactgactgacaagaattaaagagaactttacaaaatatcataatagcagatataaaaaggcatcactgaaactgaggggttaatttgatcagatgtgtctgccctccttgcttttggtcatttgctttttgttatttttttttttttcctttttccatgaaggcgaaggccagggtagctgaagtcctcaccactaaatactgaaacctaacgttcactggtcactttatggataacattcataggccaccatggtaatgttcgcttcagttgctttttcaggaacttgggtcagcttctgtctagttcacacccgttgagacacagcccttcaactgggcctgtacaagtgtccaagaggtggtcttttgacatcagagggctggtaacaccactaccattagggctgaggtaggggaccccaggaagaaccttcctccctcaggctgagacctggaccttgtgggatttctcagaccttcttaattttaccagttaattttccttattggttacatgaactgaataaagaaattcaggattttctctgaagaatcggcaatgtgatgccagatgtaagatctggaagaagcagtttacaggtttccttcagctaaattgtgcaaaaacgaaactttaattttccatgcatagtacattatatgacctatatagtcagctaattttgaaaattttatttcctgatgatgacaacttggtagggtattaaatgggactgtttaatcaaaagctggcacaaagtggctaaatacaaaaagaaagggtggaattgttttgttaatcctttcctttgccaaattgatggctgatgattaaaagttttgtaatatcttaacagaaacatggacatttcagataatcataatatttaaacacttttttgcctagttctcttctctccatagcctcaatcaatgcataattatataagagaacatttacaccgaatgaaaatgtcaccttattaatgagtatttaaacccatagtttaaggttagtttgctttagatcaatatttaggtttgaaacttgtagaaactaatgatctatggaattctttgggggtgaaggctttaaaacatatcccacttttttgatttatggatttacttgggctaatttctaaacaggcattcccagatggaaatacttcagtgaaatatcactttttgaatattaaatttttactggagagtaattttgagaagcaaagatttgaatcatggtagagatgtgtgtatttatactttttggacaaaaattaacttttatgtatacctcaaatagtaaggaatcttcttagttttctctgtcttccttttacctcccttttcatttgtcaagaatttagtattaatatatgtattatggaagaaagtaagaactaacaattatgactgcattgacttgagttcatgttacaaagtttatcaataagttattagaactcaggagcgctgaatttaaattcagaaacttatttacaattaatgtgcctgagtttctatttatcaattcattctgttgaacttccactttatggtaaaacagatacaattctttcttcctgaatatttggtaagaggatttttttttcccaatatttcaccctttatccaggacaggcacctgaaattctgtgtgaactacacccctagcctgacccagccccaaacaaaaacagtcaccatgatgatgatattactagcatttgaagaagggtctatgcttattggatagctctcaagtcacacatagatgattttaagtagtgcttagtttaacttctaatctcttgaaggcttagttgccaaaacaattagcaggtttagtcagggagaaggaagcagtccatctgcttcttttgtgccactgagagcaaacagccaactgatcgactgaatccctcagacaattagtcagaaccatttgcagcccccatgtccctgtaacaaccttgttgacacatttatagatgagaagacagatggttttgctggaagtgaatttgccttttaaatatataatagcaccttataaataaatggtgtttatacataatagtgtaaaaggctttcttatacattctgaaatctgatgttcacaggagctcttttgtaaaataggtggttttacacataaggcaatagagtattacagaggtaaagtgattacccaagtttatatatgagctgggattagaaccaccagtcttttgactgccaatccagtgttttctctactacacttttagaaatgatgaagagaatgggatgctcttagatattttatggcaaatgatctaagaatactcatatcttcttcccaactataccactccacttcatggtgtccccttaggagaccagtgaacaaggaaagctgtttaagaaagcacagtaacattgcatgtgtaactaagaatgtacaaaatagcaggtcagaactcttgtaaactgggggcaaagaatgtcatctagccaaatgcaagactcttccatctctcttgaacacaaagggaaatctcaagctgttgtcattggtcaactccataggagcacaaacgagggcagagaagagagcagcagaagatgtatgatttagaacatagcataacccttccttttttaaaatcactccagctgcatagagagaaggagcaccatgctcacccttgcatcgggtttatatgacctttgactatacagtgaccctgcccactagtaaacaggaaccattctgtgacatagacctagtatgtcctagcgtctgaactgttaagtgtatatcactctcctttggaaagacacagagtggacagggaggaaggacagaggaatcttgcttccttcccctccttcagaggtcagcatgcactctgaagcgctgtaatttttacaaagtcttttcaaaagaactcatgtatattcctttactgatttgtactgtcagggaataagcagacatacctccttttatcagtctaggctttgctgtacagagacagagagcaacttaaccatggacacagaatggcaagtagcattaagtaattctgttttgaccacacttatttctgccaaagaaagctttgagatgataaaatcagctctagtgtggatattttgatatttttatttgattgagattggggaaaaacaccactatagatataaatcgtcacagcatattttgggcttacctatttaaactaaagaatgaattttttatgtcttcacagtggttaggtcagttatctgcggttataagaaaaaaattagggttgcaaaatagtacttatatttttcataaaattgcaaataagaataattatttcatactaaaagttttggtacttgacctattggaaggagtataaaatgaataaagtctgtctctattgcagatttaaatagaaggaaaagaatgcagcatttgcttggtgatgttctgtaatacttttccagataccctgagattagcccaattaccttctggggatgtttttggactaacaatactatttccacaggagactcaacatataatggaagaaactgttgagaagtccaactcttcaagactttttaaaaattgtgttttcagcttacaaatgaatcagcgcaaagagaaatagtactttagagtgaaaaacagaacacaaatcctgaactccagctaagtgtgcttttcctaggctgtatgaagtcacttcccatggtgccttgggagcaacattgttgccttttaatttcctctgaattggatcatcagttttccttatgactttcttaagacaaatgacccagcttttcctcctcttttccaggcaatggatagatggctatgaatgggcagaggaaaggatgtgtggcaggcacactagcatcccatttaatgcttcattcaaaggttttatttttcatccgccatggatgaaaacccaaaaagtccatttcactttggagccaaagccaaaagcaggactaacagaaagcgcagggtgtgagaaagacataaaatctgtaattggaaaatcttgaagttttgcaaattatctgaatagtgccacataaaaatttaattccagagatttcgttttgcccttctgtcatgttaattttgttttgtaaactattagctctcagctttggcctgaccaacaccttgccctgcctaagtctgcagtaatacagcctaaaatcaggttagtatactagcaagatgcatatactttacacagcttcagatgggagctggtaagagctttttgttgaaatgaatgagcttaggagatcctctgcaaaggtttagtcccttctcctgccctgcttgtggcattatcctaagtccatctgtgactctgtgtttaggtaagaacgtttctaatgaacccttccagtctattacatacaccagaactaataaagtactcactgatccttttaaaagtttgctctgtttaaataaatattcgtagacttttctttgcacagtctaaacaatccttcttttcttaaatattaaaaatgtgacatatgaagcaaccatgccaactggttacaagttctaaattagcagtgtctaaattaatgaggttttactgtatattaaagtataatacatctctagcacctgtgcctgatgaatttttgttcctagcaattagatgttatttaattatagttagagtctctcacatcacctagtttaattgccacattaaaaactattttgagagttgatttgcctaacatcacaaatttagtttgggaactgaaaatgccatttatttgtcctacttaagtgttattggtaagaattaagtgcaggcatatattgttatataaactgtcattttgatgtagactacatagcatatctgtgtgtgtgttgtatgtaacacttagcatatggtgactcttaagtaatgatgtgagacgtgtgtgtgtgtgtgcattggaaaaagtgtgatgaaataaactacatttttttatctcctatttcctaagaagcattttaagttgatatttatcctcttgaacagagagcagaaaaaagatcaacttatccctgatggattatatgattgtatgattattagtcttccctggattttggctaaaaactagatttgggggtggtgattggcactggatcatatatcttaatcataccagtgagctttatctttctttaatgattttttttttcgagacaaggtcttgttctgtcacctaggctgtaataatctctttaactttttatttttaaataattataaattcataggaaattacaaagaaatgtaccaggctgtctcatgtactctttgcacagcctcctccagtgttaattaacatcatgcataataccagtataatatcaaggaataccaggaaactgacattggtaaaatctacagagcttttacagtttttaccagttatacctgtactcatttgcatgtgtgtgtgtgtagatctatgctcacatgggtaccttcattaaccatcctccagaattacgatatttaatgtaacattgccacagggcttccttaagctaccccttcatagccatacctacacctcctcaccctctgccctgcccatcacaactactaatctcttctgactctatatctcaactactatataaatgaaatcatatcgtatatacccttttgagattggcttttttcatgcagcgtaatttccttgaggttcatccaagttgtgtgtgtcaatagttcatttctttttatggctgagtaatatttcagagttatggatggaccacagtttgattagccattcacccattgaaggacatttgagtagtttcctgttattgaccattataaataaagagaccatggacattctgaggaaagtaaattttaacttcactgagagaaataccacagtgtgcgatttctgggtggtatggtaagtccatttttaattactaaaggaactgccaaactattttctagagtgactataccatattacagttctagcagttatgtatgagcaatacagcttttctgcatcctcaccagcatttggtgtgatcactctttttcagtttggtcattcagatatatgtgtagtgaagtctcattgtggttttaatttgcattttcctaatgtctactgaggttgaacatcttttcgtatgcttggttgccatagaaatatccttttcagtgaaatgtccatgtcttttacctattttataattaggttggattttgaaagatctttattctaggtgcaagtccgttgtcacatatgtgatttgcaaatatcttcttccaaactctaatttcccttttcatccccttcatggggtcttttgcagatcaaaagtttctaattttgatgaggtccaacttatcaatttttccattaattggttgttgttttgatgtctaaggactctttgccaagtcctaggtttagaagatctcctattttttttctagagattttagtgttttatcttttagatttatgaccatgatccattttagttaattttcctataaggtgtgagatttatgtttatgcttatttcttttgcttgtggatacccaattgctccagcaccatttgttaaaaagattatgtctcccctattgaatcaaagaatgattattttattttattttttgtagagacagagtcttgctattttgcccaggctggtctcaaactcctggcctcaagaaatccacccaccttggtctcctaaagcgttggtattatagatgtgagccactctccctagccagcatgatttatttaaaggtacatagtccttaaataaactacatgtcctgcataaaaataattagaagtatttgagcacccaccctgtgccaggcatatttctaagcacattccctgcattattaactgattattatttgcagaaaaaaatgcgtgcagggtattgttattatcaacattttagaaatatggaagccaggttttggaaaaattaagtgatttgcccaaagtcataaagacagtgtgacacaaagtagaatccatgtctgtctaacttgaaagcctataatatgcttagtaataaaatgttttcttaccaaaggaagctcagaattaaggcttttcatctatcaagcctttattttgttgtatagtcaggaccgatgacctctttagaagacccttaaaaatacgttttttctatctcaagaactcagctggaggtttggagactggttacgaaatttgaccaggcatttgacatattatctatgtccactttaaaaaataaaatggtagtcttcatcctgaatcagtttttgacaatacactttgtcgtgccagtagttacggcctgagcatctagcacagttttgctcccttttacttggtttgtatttaacagaacttcttccaaagctgtgttgatttttagcagaggccatgtagctaaggatgactttctttatttattgagtctctaattcttttttaaaatcttgataagctattttcccagatattaacctgtagtaatgttttctttgtgatttacatgttacaccctcaatttacatatatttctactgttctacttttcatttcatggaggcttgcatagatatggatactaagacaaagtgaacaagagggtcacctgataccatatgttccttggaaggggattgatagcagagttttaccgtagttccattttctttcataaacatttgatactttggtcacctttagcaaatagaaaatgtcatggatagagcaaaaatcagaagatgaattgccttgcttcctctactgattacttgctaaatgaccttgagcagcttctaattctaaacctgcccatcctgcaagtacagatcacaaaggaaatcaatgttttgctcttgaggattagcttttattgtcttcgtgttttgcgaaatgtataagctggtcttttggaagcaagaggaaatatgttggtcttttacaagagtcataaaagagggctcatctaggacagccagggtaataaagcgggtatggtataagacacaggcataggtaataaagtgactcaaaacagtctccaataatgcaagctccctgaggacagggatctgtgtgttttgttccctgctctatcttcagagtcaacgacgatgtccggtaccatcctctgtctgctatttccatgcctgtttccacatctccatgtggagcttgcaaggtaatgaaatgaaccttggaactgttggcatccgttgccttcattgtgtccaaacaaacctcccaggggtcccaaccatcctggggaaacacacctgaaccaagaataaagaatctctaataatcttgttcaatctgctttcagtcctttggtctcaatattttttctataaattgagaaggtggccgggcgcggtggttcacgcctgtattcccagcactttgggaggccgaggcgggtggatcacaaagtcaggagatggagaccatcctggctaacacggtgaaaccccgtctctactaaaaatacaaaaaattagccgggcgtggtggcgggcgcctgtagtcccagctactcggaaggctgaggcaggagaatggcgtgaacccgggaggcggagcttgcagtgagccgagatggtgccaccgcactccagcctgggcgacagagcgggactccgtctcaaaaaaaaaaaaaaaaaaaaaaaaaaaaaaaaaaaattgagaaggtaactacggacttcattggtctattgttaatacataatgagacgatacagtgaaagaactctccaaatgacaaagcactatctccatctaagaatatcgcttctgttgcatcatagtgaagtagttccacaggtgtttctgctcggactgactggttcaaatctcggctgtactgccaggatttaagacactttgaaaatgggcaaagcctcatttttcctaggtcaaaaggagttcaagattggggaaatctgaggattcagaaggatgataaatgttagaacatggaatcagggtgcttagattcttggtgcctcaatttctctgtcagttaaatgccgtatgatcaaatgactcttttctcattggcttgatgtgagaaagaaatgactacatataataatcagcaacattcctggcacatagtaaacatcgatgtattattattaatacctccacctacgctatatactgactctctatcctccctctcttcctccttccctggatcttaaaagatgagtgtgattagaaacaaaattttgttgtgataaagtccacctgaatgttccctcagatactaactaaatctctttcacatgcaacctttggacaaaagtctcttcctttttgctaggaattttcctatttttctcatttcttctcctcctgctttaggaaagaaaaaaaaagcatatgcaagaattattttttcttctccccagatgtcaccagcactaacacctgtcctagttccagctctggtgaactccagcagacctgctcaagtggacagcattagggaccttgtcagttttgcagtgctttttgcctgaagccacctcaggtccctcatgctgcaggtatgctgaggggcctggaggtgacaggctgttttgcacccaggcacactgaggcccgggtgctgcagggctgtaagggtggccgtactttactctctcccaactcccccacccgtgtcatttttatttgtactttataaatccttttcacttttgcaagttccttttggccgcaatctgaatgcagtcctgtatgggataaaggaatatcataagtatatattttttaaaacagcaacacgattcatgactctgttgcagaatgtgaaggagcaagtctctcaattggctaattgaatcaagctctggtgagtatgttgagctctgagctctcctgaagttgggctctgagcctgaatcaattggtctgatctccctttctctttatttgtatagaaatgagtaggaattctgtctgtgttaataatgtagggtaattttggaaaggtaacttaaatttccaggctatggtttatgttcataaagtaaagataatttgaatattgaaccactgttggctaaaaggcagaattaggtgtgacctcacttagagtacttagttgcagactgttgggggaaaattctcatattaaggtttagactttgagaatagggtgattgtgagccttctgtacataactgactttcaatacatgctcattaaaaccaaaaaagctaaatgattcaaacactaaaaatattcatcgtgttaatttctcataacctttatgcagtggcaatattgcataaatatttgtttgtaaagtgtaaggtcagggcttattttataatgcaagaaatccccagtttggttaatacaaaaccttaacaagaaccagtaagtagaaacacttgataaagctatataattgtagatcattagtggggaaaagacttcaatttgccttaggcttgatgtttctagaaataaaattattgagaaaagattaaggatgagataaaccatttggaggaaaagaagatcataaagtgatagaaaccagatcttaaagtaaacatgttattacagttgacctgattggttggaagacaatgtacggtaaatgcacctgacaacaataacttaagcataccctgagaatgactctgtatggcagatgcacctgaatgtgtgttcagagctggggaatctgggaatggcaaacctggagatgggctccttatctatgataaacatctgagtcctgagttttgcggggtgggtggtgggcggggggcggggggcgggggctgggggtggggtagggagggtagatgaagtttgccaggtgcaggtcattaggggagggtgttaagtaaaaatgctgtataaactgcatgatgtttgcaggcagttgtagttttcctgtccagcccacagccactggactgtaggaaggcgaatatgttgtccagcccattgccatgggaccatttctgtaattaagggtgttctcctgtccagccctctgccacagaactctcttcacggtatgaaagcccctaataaaaccacagatcttatttgctggctctgggtctcttcttcagcctcttgaacctggtgccttccctactgaaggtaataggggctcagcacaacagatcacccacacacaggccacctgccttcagaaacccaattcaaatggtcataagcaccaaaagaaacagatttgctcaggtgactaaaataatccagggaataatcagatggaggaatgtggatgttatccccaggacttgatctcccctagtccctgactctgcctttcccatgttgccctcactaccgggcagaccctttctaccatgtcaagatcactttgggaattccaggcttcaactccactagctcagcaattctacttgggagaaaatgtcttccccagctgttttagtcacagctctgacaactcagtctcagtacctggtttgagtcataaggcgtcactgacaaaatcacaactgtcagggcttgagatgtgtcatttgtcctatgtatcaaacagcataagaagagtggtgtttccccagaggaaattgagattctgttatcagtaaaaggggaatggctgctcaggaggcaaaaaaaacttgggtaccctccaccaccaatctaccaaatctggatttgaaaggcataggacagcagacagtcaggactaagagcaagtcgcaccaagaaagaagaagaaaactgaaagggaaaatcagaaagccctcctgaggtccatttcacccactcagtcataaaagagcagaattaaattaaggctgctaaaagtagagaaggcacaccattgacccaatatgaagccctgacaaggagatttgttgggtttttttgtgagtaccctcctgagccagaggtggagtgtctcctcttgggtagacaactttagtgtgattcatgtgtttgaatcacacagcctccgaaggccacgtgtctagaatagcaccaaacaatgaaaaatggctctagaaacatttattgttccttcagctttttctatctcccaaacgtatattgagactaatttattaatgttaagtcatacgataaattcattctgggaggaaaagcatttccagggagtaactatacgctctcatcacttatagctttgtccccgcctcatcatccagggtgatgattttaatccagacttctccatgtactaactgtggaaccctgggcaaaactggctctctatttgcttatctttccaaaggggactataatagtataccctgcagaggtacacatggctgttattactgtttacgcatttgggcttcatttggagacagtctcagaactgatcttatagcgtaagattatagaatgagcttatcatataagacatacttgctcatagtattccaagaaagtgcaacacaccaatgcttaatattaggagtttagaaactaaactaggaatcagattactcctggctcagcctgggcccttgaactaacctccactgcatattttgtcctcacagcgtccccacagcagctatccaggcttcctaggaataacacacaatactccctattctcaagagagtagctctttccccaaaatcttgatgtactcagtcagctaagaggtaccttgcatgctttaaaattcccacctattacttatttttttaggtgaccagtctctaaggcagaacaaaaattacttgagcggggatttagacagggattccaagaaaaaaaaaattagctaaattgggcaagcctaaatgatcttttagtcatttgttgttttttttttttagcaatttccttcttccctggagcctgatcctgcaggacaaggatctattttcaagtcaattacaattcctaagggatataattacctacaaaatcagcaaaggaaccctatttctcttatggtaatgtaatagtaatttttaaaataactacaatacatatgatagaaatggcatttgctttctttcaacttttcattgcttttagtttcatgccataccattcccaaatctccaacttaccagcaagcagtgataaatggcagcctgtagattattgttaatcaagaaaaaaaaaccaaaataaattattagtctattatacaccattgtggctattctatttctcatttggtaacattcagaagtctcctcaagaactcggacaacagacccttgagagtgtgagtggtgacaatggatacagactgagctgcccagaagcctgttcatagtctcagactccaaattctagggctcaactccagttccctgcccacagtgtggcatttcctatcctttttagctacttaaaaaaaagtttgctatggctatatgctaagtactaagacacatattctcattttatctacatgccacttctctgttaggagttacaatattcccttcttttgtcattttcatttcattcattcattgcatgcccactctagaccaggcaacagcctaggtgctatggatatagcaatgaagaaaacaaagatttgcatttcagtggaggagaaagacaatatgtggaaggagaaagtgaaggagaaagaagaggggaaggaggaggagacatcagggagatgacatttaagcagagacctaaaagaagggatgttgtgagctcagggggaaagtgtttcaggtggaagaaccatcatgtgcaaaggtcctgaggcagaaacagtgcttgtgaagaacacagcatggcctctgtgagtgaaatgtgctgagaggggttggaggaatatgagctgatagatagtgccaaagccttggagggcaggaaaaaacactgggtttctttcttttgatcagccatatgtaggtgccaggaaaggagtgatgtgatttacctgtgaggaaactgaatctaaaggaatgttaactaactcatccatgtcacatatgtgggaagccccatcatcgggactcacactggggtctatgcagttcccaaggctcagtcatttataatcacagcccagcttctcagtcactcaacagataattccatgtatatgtgctctgtcattgcctttataaagacaatgagatctctttgagatctcttcactcataatctcagttggcttgtttctcatcttcttccttgatcctaaatgtcagcaaatctccctctccagtcacaggtccaattaattatctcttatgaaattcaccagatgtaacccttcttttccattgctcctgctactattcaggtttcaagttttgtctcaagtcttgtctgctctcacttcccaggattcctgaaccctcaatgatccaatactagcctacatgttcaatttcatttctcctcattctctcatgtctcaaactggtcaccttcagactatattttgactatatgctattcttaaaaaaattacatcaaattatattactgatatctctttaaaaaattgaatctgacagtactgggcccatggtcccacaaagctgaagctgggtagtggctgcccattttggatggggcaagagctctccagttctccacagtctccaccactctgtaaaatcagacatcgtcaggcatctctcttatcattggaggcatctgtcttatcattgcaggcactgacacagttaagaatagtggctataagtactttctgaagccaaactgcctgggtaccaattctggctctaccacttactaaacttatgttattgcccagctacttaaaatctctgtagctgccctgtaaaatttaggtgatatggtttggcagtgtccccacccaaatctcactttgaattgtagctcccataattcctctgtgttgtggaagggacccagttgcaggtaattgaatcatgggggtaagtctttcccgtgctgttctcatgatagtgaataagtctcatgagctctgatggttttataaaggcgaagatcccctgcacaaactctcttgccaggtgtcatgcaagatgtgtctttgttcttccttcaccttccaccatgattgtgaggcctccccagccatgtggaactgtgagtccattaaacctctttctttatgaattacccactcttgggtatgtctttattagcagtgtgagaaccgactaatacagtaggtaattatgataactacctcatatttctggtgtgatggttaaatgcactaatacttataaaagcatttagaaaaaatagctggacatagcactcgataaaggttaccttttgaggttgctgtttataattcccactgtataccaggtaagttggtatacttgtcaaaatgaacatgctttttacaatcccatctccttgcccttgcgtactttaatcttgcttcccagatggttttcccaaatggtccagtcttctatgatcacagaatcttatccatctcttaagtaaggcctacttcaaatctcacccatttgtgaaaccatcactggccactctgtatagatattgtttctcacttctttctatttctgcagctcagattttgtgcactacttactgcatactcatctaaccctttgcattgctgtttaactgtcttacattaatattttctctctccagccagactgaagaaccctaatggtgatgcatggcaggtgatgattgggttatgtttcaactttctggcaggtagttggcagcaatgctagatagtacaatgattattttctgaattctcatggggaggattttatcatgacatttttcttggtcaatgatactaaattagaaggttagatgtttgtctaatgagtgcaatattgaaacaggtagtatgttttaaataacaaggttctggagttgaaacaggttttgtgccccttctaatacaggttaatgcagaatgaaggtcattattgtgtgacattagtttcagattgaaggtcattatcatgtggcaactgggttttgattcagtgctttcctactttacagaagctgcaaacataattggcaaatctgtaaaaatgactacagcattagtttctttgggtttctgaaagttatgcatggaactctgtgtttctgtctatctgtctgtctgtctgtctgcctgtctatctatctacctgtctatgtatgtatgtatgtatgtatgtatgtatctatctatctatctatctatctgtctatctatctatctatctatctatctaatctgtctatccattgagaaatgagtatacttcctactgggcattggtcttcaacatggataaaacacagaacatgagaattcaatattagaatatgggacaaagacagtgaaataattactgagaaaaatatgaaaatcaatttcatcaaaattgaaccacctaagacgattgttagtggaagtatagtaattagatgtgctttttcattaatgtcagctaatacctacctaaaatttagtgtaatttcagaagacttttttaaacctggaagaaagatacttgtaacatcatttgcattaatctctgaaatgaaacacttccatatggctttcatggtggggaggggactataattactgaggtcactttctaaataatactactggaatctattcatatgggaaccaaagacatgctgtgatgccaagttatttcctctgtggaaataaagataaaggtaaggtaaaggaagggtaaagatatataggaatattacagatgatcccaggatttaacagtagacctaccacaattaagtcccagttctctgaaagtgaccttctaggatgttcatgtctgactttactgtactaagggccattgtattatataggcagaagagagtaatgagattgtttgattggttagagaatgctaaattaatcctgccagcagtaagccaaacccacagtgccagcctacacagtacaataaatagaaaaggtaatttgacactctgcccaaaaaactagctttggaagtagcagccacttggcctcattgaaaagtagggagaaaatgaattttgtaatgaattacttgtcactcaaaagatatttggtttacaacaggaaataaaaatcattctgaagagtggccattttgcctaaaaggaagcaatacatcaaataagggctagtgaaacagatgaagagtattcattcatctttaggtcatctgctgacacaaacaattagattaaagtggaatgattcaatctgagaaatgtgaatggatagagaaggaataaagaatattctttagttctcaaataactttttattaaatattattgtttctcttttattaggtttggcttacaaacctatattttgtaaatcttatttgtgttcaatttagaaaaacataatccatttacatttattggttcggttctgattgcagtaatcattaaatctggataatgaaaaatattcaccaactcttcagtgtaccaaggaagtattgagaattgagaactttttttaaggtcttagtgtacaatcagtaatcaccactatttttccttcgatgtgacatttattgtgaagggacctatatatcccactttatttctgggatttggagctaaatgttgtctctatgtccgttcaggtgatgccagggtcaatggccacagcatagaggatcactaatagaaaaccaaagcccattcttgagagttttatagggttttttttaatttatttgtttgcctgtttgttttatgaaggataatgatttattttttaagggaccctaggcttcttaggattttctgtcttctgaagatattgactaaagtgtccaaagtggggatggttggagatgggctaataggaagtggaaaactagtccatttctctggctaacaggcagttaagtctgtaatacactgatatttcagtgttaacaaacacttttaattaacagaagagaggctaatgaatcaatttactgataatttgtgaatgaattaatttgttaatcaatctatttactaataattgtttcctttcagaatactaactctgctagagtatttatctttgataaatagatactatttatcaaagccagaaaagcgcattgaaatactttccaaatattagattctaacatcagatcagatggctactccaagcacctttagactgaggcattataacattccttttaggtgtgagtagaataaaggaatttttattcccacttgatattggatgactctggagggaggtcctagtgcctacttactgaggagtttccacagttgtaaatacacttcctcacctcaaaaagtcttcctttagccacaggggaaatgctgctttttcaatacgaggagttctctcaaaccagaacttccttagctctgaggtgtgtcacagtggtcagagcaggtagactggctgggagaccaagaccttgattaggctacctaacatgtttgtgccttggttaccacatctgtaaagtggggataataatagtacctatctccacatattgtagtacaaagtcacatttttaacagtgcttgatccaggatgttactctcaggtgcccaccctaagagagaaaggtgtcattgaaagaattccgtctgtaaaattattttggggtttcttaaattcacatagtcttgtacatagtttaatgtacatggccttggcattgtgtaaaatgttatttggacactctggaagaagaggatagcaaatttgattctagggttataagactggagggttaattataatataaatcagtcaggtaattgggagaagattggaggaaatttgatacatgtttatgtgtttatcaagtgattgcatctgcttttcactctctgctgccaccatctggccccaaaacctttgtatgagccacaatagtcacatccctgggacatctttgtgccccctccagtctcttttccacacggcagccaatatcatttcttatgattctctactggttcatgtcattcctacacttggcatcactcattagttggactttggataaacagaaagcatcaagctcttgcctcctttccagcttcatctcatgtcttccctcactcgtaacgctctgcttatgccagccttctctctggcccttgactatatggagttctttccagcctcagggtatttgcaacctgctgttctgctacacaggacatctgccattcacactttctatctctcactcctgctcatcccttagatctcagctaaacataactttcttggatggcactcctttaaagcccagccacccgaccccagaatttaaattggcctctccccatccttaatctaatttccaacagggcatactgaccttttcctttgtataacttattataatttgtggtgtcatgttttctatatgcttgtttaacctctgtcttccccaatagacagttaactttataaagccatggacggtgtccatcttttttttttttttaagtgctgtactctgcctcagacaagatgtggttggtgcttaattaatagttgttgaatcaatgattacatcaacaaacgaacacttagtatgtgacaagcactgggctaagtgcataatactcatgattttatttaatcctcacaataaccttttgagttaattatcattaatgtcattcacaaatgaggaaataatacttcttcatgcagtgagcttagaagggactgttacatcctctaaaaagtggccaaccttcccctagagtatgggctagactcagtaacttgcttccaaggaatagagtatggaaactgaaatgatggtaaaaatagtaacctcacagtggataaacttggaagccattatcttaaccaagtgaccaagtttaacatatccaatgataagttatcatgtgccccctgatttcacctctgtgattttcttctctaaaattcataaccccagcctaactataaggaaacatcagaaaaattcaatttcatggacattccataaaatatctcttcgaaactctcaaggtcatgaaacagaaggaaagaaagatgtcatagattaggaggaggctaaggagatatgggtgctgaaggcaatgtgtgatcctggaacagaaaaggactaaagtgaaaaaactggtaaaatccaaataaagtttagttaatagtaatgtgtcaatgttaatttcttagttttgacaaatgtgctgtggttatataaggtgttcatattaggagaagttgggtaaaaggtatggaagggctctctgtagtatcttcgcaactttctgtaaatctaaaatatttcaaaacattttcctttaaatggctacattggtttggaaaccagggctgacctttagtcagcatacactcgtggttgatgtattcaagttgatgtaatatattggcttcaattggtcaggacttgagcatggcatgttgttgaccgtattgagaattactaactatgctccctttttacaaaattatgatcaactttctattcactcaaaagtattttttaataattcttttctcagaagaataagaaactgtgtgtgactttaagtcgttctatttaactgagtggttaccatggtgaatctaagtgttcagagaataatttcaaatcgaaactccagataatgcttatgccacagcaaaagaaagatcagctgtcaatggtgtggtttctcagagccacataacaaatataccaatttatgcctaatattggaaatcttctagtccaaccttactgggtacttgttggagtatcagaagaggttgaatatgtttttccaggttcactttcttccttgggatgtcacagaactgaactctatcagaaatatgctagggcatgttttattctcttctgcatcttctgtcagaaacagccaacaagtgccattttcaagtcgctacagatctcacctagacccttggaaatatcaggttctgctggattctgatcaagagtgcccacgcagtaacttagaatctgaccagcatgccaggactcacatctagctcttcccaaaggcacacgtgggcagggattctcaaatcatctggggatgtcgataaaccacagatgctgactcagtgagtgtggggtgaggactgacactcttaatttccaaaagctcccaggtgccactgtgggtctttgggactgcattttgaatggaaaggtgctagggtatttttaatgacatcctaacgaaattatgccattagggatttaactgtgtattccacagctttactttccttttcaatttaacctctttagttcaacaatgtaacacttgtggaactccacaaattaggatgcaaaatgaacaagaaaagggatttagttttaactgagatgtcccttcacaagacattgatagaaaaagtgaatttattcttttggcttaggagtgacttggcgatgcgggctcttttttggttccagatgaactttaaagtagttttttccaattatgtgaagaaagtcattggtagcttgatggggatggcattgaatctataaattaccttgggcagtatggccattttcacgatattgattattcctacccatgagcatggaatgttcttccatttctttgtatcctcttttatttcattgagcagtggtttgtagttctccttgaagaggtccttcacatcccttgtaagttggattcctaggtattttgttctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggtttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagtttccaaagggaatgcttccagtttttgcccattcaatatgatgttggctgtgggtttgtcatagatagctcttattattttgagatacgtcccatcaatatgtaatttattgagagtttttagcatgaagcgttgttgaattttgtcaaaggccttttctgcatctattgagataatcatgtggtttttgtctttggttctgtttatatgctggattacatttattgatttgtgtatgttgaaccaggcttgcatcccagggatgaagcccacttgatcatggtggatgagctttttgatgtgctgctgaatttggtttgccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagaaggaaatcaaactatactacaaggctacagtaaccaaaacagcatggtactggtaccaaaacagagatatagaccaatggaacagaacagagccctcagaaataatgccgcatatctacaaccatctgatctttgacaaacctgacaaaaacaagaaatagggaaaggattccctatttaataaatgatgctgggaaaactggctagccatatgtagaaagctgaaattggatcccttccttacaccttatacgaaaatcaattcaagatggattaaagacttacatgttagacctaaaaccataaaaatcctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaacgtcagagtgaacaggcaacctacagaatgggagaaaatttttgcaacctactcatctgacaaagggctaatatccagaatctacaatgaactcaaacaaatttacaagaaaaaaaaaaccatcaaaaagtgggcgaaggatatgaacagacacttctcaaaagaagacatttatgcatccaaaagacacatgaaaaaatgctcatcatcactggccatcagagaaatccaaatcaaaaccacaatgagataccatctcacaccagttagaatggcaatcattaaaaagtcaggaaaaaacaggtgctggagaggatgtggagaattaggaacactttgacactgttggtgggactgtaaactagttcaacccttgtggaagtcagtgtggcgattcctcagggatctagaactagaaataccatttgacccagccatcccattactgggtatatacccaaaggattataaatcatgctgctataaagatacatgcacatgtatgtttattgcggcactattcacaatagcaaagtcttggaaccaacccaaatgtccaacaacaatagactggattaagaaaatgtggcacatatacaccatggaatactatgcagccataaaaaaatgatgagttcatgtcctttgtaggggcatagatgaaactggagaccatcattctcagcaaactatcacaaggacaaaaaaccaaacaccacatgttcttgctcataggtgggaattgaacaatgagaacacatggatacaggaaggggaacatcacacaccgggaactgttgtggggtggagggagtggggagggatagcattaggagatatacttaatgctaaatgacgagttaatgtgtgcagcacaccaacatggcacacgtatacatatgtaacaaacctgcaggttgtgcacatgtaccctaaaacttaaagtataataataataaaattacaaaaaaaagaaagtgaccccagtatgagataatttgaaataaaaaaaaaagaaaaagtgaatttatatcacctacctgctaaaagactgattttataaaatgatttatttatttaggtagaatcatttgtgatccatgttgagcaagttggagaaacgctctctgctcaatctccaagtgaactaagggctttgtcaacttgaccaaaataccgtccaatttagggactgtttccatttgctagataatcctctcagtttgtattcttgcttttttctcccattatgattcactaactagtgattacccaaaccctaagtcctgggtttaggattttttttttttaaattttcagcttttattttagatatggagggtatatatatatatatatatatatatatatatatatatatatatatatatatttcatgggtatattgaacccagccaggtagtgagcatagtatccaataggcagtttttcaacccatgcctccttcttccttccccctttagtagtccaccatatctattgttcctatgtttatatccatgtatgctcaatgtttagctcccacttataagtgagaacatgcattatttggtattctgttcctgggttaatttgcttggaataatggcctccagctccatcatgttgctgcaaaggtcatgatttcattcttttttacggctgtgtagtattccatggtatatatgtaccacattttctttatccaattcaccactgatgggcacctaggttgattccatatctttgctattgtgaatatagtggtgatgaatttatgagtgtgtgtgtctttttagcatagtgatctacattcctttgtgtatatacccagtaatggggttgttgggtcaaatagtagctgtgaacacttttgggactgtggttaggccagatgtcatggttcaaatgatgttagacattaaatgttgtacgcattttaaatcttcagatcttataaagttttaataatttctgtagttttattgaaaacattgacactgcttatttgagtcatggattgttatatccatctggaaggacagtcacccctgatagaacacagcattttctgttagtcagcataatacaggtttttagagtattactcatggggttggaagtttgattttattcagaaatatttttaagagatggtgtcttactatgatgcccaggctggactcaaactcttagtctcaattcagagattctaatatccctcacatagggttttgaaccctgaaaattggtaaaagtatacttctatggtataaaccaatatattatacggtggaatttcactgtgatttgctaatacctgacatacaatatgctgtttagtctcttgaatagagactagtctcatccttatattttgtcatttttttgtggaacatacacaaaaattcaaatttttcatgttcaaaatttgactataatccctcttaggtagaacagatactttaaccacacacacatacacacacacacacacacacacacacacacacacattttgtaaggggatactgaggcccagggacttactcatagtcatgaagttactggcatttgactctggaaggggtgatagagatttcatcctatgacctcgctttacagaacaagtaatgaagctgagagaggctgggccacttgctcaaagagttacagcaagtgagtggaggggcggggggcggtcaggactcaaagtcacctatcttgtctctcaatccaggataccatcccctgccattctctgtctcaggccagcacagcactgggcacccagcatccttagtctatggtctaggtctttttattacactataaacctatgtttcgtgtatccaagcacacaaggtgatttggggaataccatatttagacaaacattgattttgaaattattcatttactttaatgcatatcaatatctgtgtatcttctatttacaaatgagaatgatttgccaaataacagctatatagaattttatttttttaaatatactcatttcggtcaaaataaagtagatttgaggctgggcacagtggctcatgcctgcaatcccagcactttgggaagccgaggtgggcggatcacttgaggccaacatggtgaagccccatctctactaaaaacacaaaaaattagccgggcatggtggtaggcacctgtaatcccagcgattcgggaggctgaggcttgagaatcacttgaacccaggaggtgaagtttacagtgagccaagatcacaccaccgcactccagcctgggcaacaaagtgagattctgactcaaaaaataaataaataaagtagattgaaaaaataaacaatagttcaggtcgtttgtggagatggcaaatattgggcacacagattattgaagtttgggaactgtcaacatacatccctaacatcttttaccttttcatcaccatttatgtgtctgcaaaacttacctggctgtggttctcttatagtcactccagccaatgaaatggaagcaactgtgtgaaaactacaccagttaacttataaaatttcaatgacagaggatgggtaggtagtgaccgcaagaacacaatacattctgagaaatgtttcaatgttatcattttaaagtaaatcttagaattcctattagtgtagaagtaaactagcattacctattttgagcttaacacagtcaatgaaagtctttatcaatgaaagtctttatagaaagtatatatagataatttctataaagaaatttatattctatataatttctataaagaaattataaagacagaccaaacttttgacaaaaatctgcttaaattgcttaaaacatattttagtgatagataattgtttatttcaagaccttcacaatttgagcaatttagtgttgcatctgagaagacagagatggtcagttttttaaacaaatttacataaaaagatatgttaagattttattgataactattaagatctgctataataatatgtctctccatatagaattctcatatttatgtgaaaatgtatgcaaaaattgtggcttttaatatatgaaatttaaaaactcatatacaattttgctggcaaagcaagatatgtgttcaatttagtatcatttccataatcccaatttttattttcacctcatcatgattctgttaaacttggaagctctttttaaaataatttcatccaaaaccttttctgaggctctgatcccttagatcttgatctcctgtttaatttccctcagccattaacaggtgtggatttcattttctttgtcttccttgctaggaagtctaaccacagcattctcactgtgtactccaaagggccctggcctggctgctttctacatcaacctaatatgtgaggtcctttcatgtgaaaatgactctccatcatcagggtcacctcattcattcattaaaggtaatttagcacactcacacagcatcctaccaagaccagctttttgacttttgtcaaggtttatccacatcacacttgacattcctggtgggaatttctatgaattctgaagcttcagaaagatgttttgatatgtcccactaggggaaggaacttttccagggcacagagtgatatgaggcctgaactaactgggttcacctccaggcctgagaaagatgacatgaaccagaaaagcatggccttacagctggttggaaggagcctgtcttgctgaggctcattacagaactggcgcaagatactcagatccgttcattcccctggctgtgaactgttgcgtactgcagaagctgagtcagccttctacatctgggctgcaggtgtagcccagacatggctaattaaaatgccaggccttagtggtataggactctttctctggggcactgcacagctctagcatgtcatcctaaaaggtttatgcctgaaagtaaaagttcagaatattaagaagaaaaaaaattgtataatccctggaatgctaatgtcttgagtttctaaattgaacggcactgtcagattaggctctattgacatagtcagcaagttcttattcttcttgcctgtgccaggctgctgcatgtcaggacataaaatgttcccttcataggcaaaagaaagcacccgtgataagtatactattaaggaaaagtggtcagtgttcaggctgagttgagacaggagtggaatgtcatctttctcatgtagcgcgctttaatttacagccaggatggtcatttaagcttttacacactgtaataaaggtgtcccagcagttggtagagagtgaagcttgatctttggcttaaaagaatgagattgagatataaaatacctttaattgaagagatctgtatcacaagggttgtgaagttgaaggttttatacgaaacataactgctgtctttacccagaagagtagatataaacagcccggtcctaagtaaatctctgacaccccttcactaccatcccgcatgatactggcatttggtttgtttttcatggtttataagggttttcacaaacagaaactcgtttgatctttatacctttctggaagatacagtatttttattctccctttaccgagacttgttgcacatttgaaattctgcatttctagaacatagggctgcaaactatgtgatgtggatttaggagcatggggcattgcaggagacacataataaaggatccgggtgagagcagaggaagacacagttcccagatgcttggcacatagtgaggatgggaaagggaaggccaaagaatctggcagctctggctcagcagttaacctgtcttctgtgttccacctctctagaggatgctgcccaactctcagcgataagtatgtggttttaattggcttgttatcataatttgaagctacgtgtcctgcctgactagtctttaatgaggcacatccactcttgggctcagtcaagcaaaagaaccttcggtggactccagtttctcctatgaatattgccaaaggtacagggggctttgggtgccaataaaaacagatttcccattgattgacttcctgcatgcaaataatcctcctccctagggaacgcattaacaagagaaagctgagtttctcctcacaacaagtcaagtttattccgactcatttgtgtaaactggtctataggaacacacagataagacttgttgtgttaattagcctcatctaatcattccacactgtggacatacatcaaaacatcacattgtacccccaaaatacaatcattatttgccaattttaaaacatttgtaagaaacttactgaacccatacttgtatgctaagcccttaacaagtatcattttactcaaacaaaactgttctacttaggttccatggttgtcacatcattatcatttcagacaaggagaccaaactccagaagttttagtaactcatataagttatatggaaaatgaggtgtgaagccaaaatatgaggtgcagctgtgggaaaccaagcctgtgtacctagtgatcccaagaattatcccaccctatagatggaagtgcttttgattggtgccctgattcaagtaaatttgtgcagggaatttttggagattttccttcatgaaaagataactgattatgttgatatttctctacgtcttgaaagttttgttctatcttgcacaggttatttgaaggattcttttttttttaatatttaagggaatgaaaagatataagccttatatggatctatgcatgttttaacttttcaagtcttatatgactctatgcatgttgtaacttttcagttcttctttttcttttcctgtaagcacattttctgtgactcctcttatttcttcaaataggtagtccacaatgggaagactactcgcacacgataaatctctgctagacaattgtcagataattttaaggctgctagatgctactataaatacaaactggcaaagataacttagttctggagtttttcttagtcatgaactcattagaagagctatagtctcttgccattgacagcccagagaatgcattttccttgttctttgtgttgaaaaatttctgactttgtttcaaagaggtgttaagaggtgaggcatgttttcagaatcatactgttagtctcttttataacatcatcttccaaaaataaagttctaaggtatttgactgccattctgagtcctccttattctgaaaggatgaccaaagttttggctctgagagagaatattctaaaaaaggacagctacttcaggatataagaaaataagaggagagagagcaccatttcagtttaaaggaggaaagacatattttaagatattgctgaaactttgacattttgagttttagcagattcaaacaggagaccaaaaacgtgtggcccccgtgactcaactcattgtgggtgtggagacatggatggggggagccaggcagttcaattgtcagctaaatattagagtccttgagatattttcttcctgtgatatttgacctctttttgatgggtattatcatcattttttctcccccactgggagaaaatatggtgaaggaaatgaaaggtgaaagggatagcaaagaaaagaatggatgaatagtgggtagagaccaggcaccctgacacagggaaaacagggtcaaacgaagccctttggttttcttccagaaacctaaaaatatccacctcttgcctgattgacatttccactctgcttgccttatgcatgtgctgtaggggctgctaatgttgcttaactcacatgctccctgcacttttctgctgttagaaagaaaccagtcagttgggtaatcatgataattaaaaaagatgtaaactttcagagtggctgacacaaactcattacactaagctgtcttgcctgactgaactaacattaattccaataccccattacattctggcatgtaagaatttctaactaatgtggatatttcttccttcatttccttacccaactcttccctaccttccttcattcctcccttctttccttcccttctttctcatctctaacacattcccattgatgctgatgctgcctgtccaaagaacaaacttttgctgaactgtttgaggctaattctcccaaattgtaatgtgcatatagatcatttgagggtcttattaaagatgcagattctggttgggtgcattggctcactcctgtaatcccagtgctttgggaggccatggcaggaggattgcttgaggccgggagtttgagaccagcctgagcgacagagtgagaccctatctttacaatttcttttttaaaactagctaggcatagtggcacatgcctgtgatcccagctactccagaagctaaggtgggaggatcccttgagccaagagttcaggttataatgatgaggttacaatgagctatgattgcaccactgtactcaagcctgggggatagtgtgagacccaattctaaaaaataaaaaatacaaattctgattcagtaggtctgaggtgagacctgagactttgcctttctatgagtgttccaggtaatgctgatgctactgacaccagggcaacactttgagaagtttcaagacaatggtccacacatttccagtgggattagagataataacttttggccaggagtgatggctcatgcctataatcccagaactttgggaggccaagatagtgggatcaccagaggccaggagtttgagaccagcctgagcaaaatggcaagaccctatttaattttttaagagaattaaaaacaggtaacatttttaaaaagagagagaaccagttttaatgcacagcaaccaaccaatttgaaggattctttttttaatatttaagggaaggaaaagatacaagctttatatgactctatgcatgttgtaacttttcagttctaccttttcttttcctctgagtacattttctgtggtcgaacctgttactcagatgtgcatttggtgaaacaatttctatgcctaccttggaaagtctgtgcccctttcttcaggctaaaaggcatgctgcaggaaaccacatccaaatgtattcctccctttctttgtgccaaagagttggagtttcttagaactctagattttgacggaagtagatttcaatatctgcttcatcactatctatacaagttccggcactaactgattgcgccactggagctccagcttcatcactttcttaatccctctaagcccctgtttagaatgaggttgaaatggtgggtactcagtggggttgtggaggggcttctatgacagattatcagaacatgggggtttataaatgatagcttctaatattttgagatgactcttgttgcatttggtgtgtttgtgtccagaagaagacagagcatcctcaaacctcttatgttgcctacacttgaagttagaaaatatttggttttatgtggaccaaaaaccagaccattcttatgtaaaatgtgaagactcattgatgtttttatgcagcatcgattcccctgtcagggaaatcatttgggatttgcttattgttatgtgtaaagaatttatgaaaaggaccaggttatctgtggacccaggatgaaagtataacctgggtctaccaaaaggctcttccaaactcaagtacccttccttttggctggagctaccctcattaattagagctgatcctgtggatgaaggaacaagagggaaggtcaaatataacttcattttctagagggtgtgcctgactggcccactggcagctatgagatgtattatggattaaacagaagacaaaaatcaagcctcaatttaaagtttattaatgaagcacctggggggcatttagcatacatgagcttttgttttttaagaaagctgacagagtgatgaaaagataacaatttttgtttccattgaagacttcttaaaaacattgattttccgtccatgttaatcaagactctttgtggaaaatgatagaaacccaatctaaactgcttaagccgagaaaaataggtaaaatttattgggttaactaactgaagtttgcaaagttgtagctgatttgggacatgacaggaggcaaggggtcaaacagcatcaaattctaccccaccctgccccttcccccttcctctcttggtgctgcttcctcctggattggttttaaattcagaaaacatctcttcatgagggtgcaaggatgaccattagccactcctccaggcctattttcctccaggtcattcattccaacaaaacacccaactcctgcttcccagctggacccacagaagccctaggatcacatttcacaggcctggctttgccttactcacactccataaccaatcatattgtccaggggatggaattgtccacctctaattggccaggcctgggccacatcagccccactcaacccacgtaactgagaatgcaacaaggatgatttccctagtaaaactggggtattattccaagaagaaagaaagaatgttgggtgggaaaaacagcgatttctaagaacccaaagggagtaaaatgacacgttccttatagaaacttggacaagagatagagagtcccaggttttgcaacaaagttatgatgttgagaaacgttttctgatgtttgtcacaatcacaaacgaggtgtttgtgtcgaataccccacagtgtccaaagagttaatatttcagaggatgggagttggggaaacatttggaaaacatccacctgtatttcatctccccccttccatattagatttttctctccctgtctcttttgcctctttgtctatctctctctctctctctctctcacacacacacacacacacacacatttaaatatatacaatgagtttattcacctcagaagcagggatgtgacaccagctggagggtttcactaatatgattgaaatatggttaagtgattttcaagtatacagtgatttgcactgtgtaactataaatagatgctcagggggaaattctctttccccgatcctattgacttatggcaatgtatgtggagatccaagctctgagcagagtgaaatatgcctttgtattgcagttgctttctgccaaagatagaaatcactttacagaaaaagagccttattcccaccaggtgaaaagctgctcttttgtaataaaacacaatcctctggaaaaccacgttagcttctgtgtgctgctggatcttcatttagggaggcagcgtagtagcaagagcttaaaatgtgggcatccatctgccctcagcttgttctcttgcttggccttttctttccttggtgacattacctgcttagcttgtcaaacccaagcttccttgtttcttcaaagatttgacaaatttacctaaagcatatggggttatgaggatgaaataagataaaacacgtaacatggggcctggcatatcataaaatcactaaagaattggtgatggatgaatatatggttattgagtataatgggatgcaataaatggaacataatgattcaatgcaaattagggaaaacagcacttttattctgtttttaagaaactggactttttaaaaagaaaggtattaagaataccagcagtttttgtgacacttgtggaaattcatctgcctgggcgtagtttcctcatctatgaaagaaaatattcaaataggatctaaaattctcaggaaaacattcctgtgggtttagttttcatacattgtaaggacatcctaaatggtttcaagccaaagctaaccttaaagtcaggccaagcaatgagcaggtagtggcagaaactactaaaacattaaaattgcatttcttttaatacctgtatcttcatatagttagaaactgagctggacagtcagagctttgaattcaaatcccattctttcttttttcttttattctacatgaatgaactgagggcctggcctggcctgttctgtccgtatctctatgctatccatgggagttgtattttaattggtggtggtgggggggaataaaaataagtaacccaaaataaataactgcaaattatgccacaggctatgaaaaaaagaaagcaagcaaggaaacaaatattaatacaaatggtgccagcctcattttcatatagaaaggattctataagctaaggtgtatgagtaaaagccttcaaccatgtgaaggggaagaaggaaagcactccaaacagaagggaaagcaagtgcaaagcccctggggtaagatgtatttgaagactaaatgaccagcatggctaaactttagcaagtcggggacagtggtagaagttgcagttggagaaaggaagaggccagatcacacgtggccttgtaatgtgttgtcagagcttgcattgtcctctttgtgtcttgcaaaggacacatttaaaaaataaaatgttttatcttatttcatcctcataaccccatatgctttaggtaaatttgtcaaatcattgaagaaacaaggaagcttgggtttgacaagctaagcaggtaagattaccaaggtaagaaaaggccaagcaagagaacaacctgaaggcagatggatgcccacattttaagctcttgctactactctgcctccctaagactaatagaaattgtgatttgaaaccactcttgcttctgtaaataaacaagagaatataagaatggaagctagaagatcagttaggtatttctcagagaaatccagggtagagacaacggtgagctaaactaggtggtaatagtataatgcacaggaagaaatattccagtcttatccctggctgtgtgactgacaccaaattcctttttaaatccctaggactcagtttcactgtccgtaacatgagcaggtacaacacaatctctaagggactcgtatgtcaacattttattctaatttctaaaaatctctaagccagaccaactcttttgttaaatttacatggctttgatgcactgatttgctcttaccagctttcttgccaggccctagggtaaagatatgagattacctgccaagaaataagaaatgagtgcaagtcttattaagaactgtgggagttggctggccttgaaatggcattatcttttctgttttacgcttagggtggtttcaaaacagtctattcagttgtgtgcatgaatttccaattccaaattcaaactacaaatttcataaacccagattctgaatgttaagtttcattttatgctgtttaggatgatggttttcatgaagaaggacaaaagattaaaaagagctatgatgaaagttttattaaatgaaggattcaaaagagaaaactctccaaaccccatccaacatttttctgtctagtgttcagagaaaaatggtaaattaatagaaaagcaaaacagtgtgggatgccaatacattcaagaaaagccaaagttcatttctgcctgcagattcaaacactgctggcagatcaatgtgagcttcacagtgtggtttgcaaaaatcgttctgcagctaatatcctcaaggacaagacacagcctgctttggctactcttcagagtttgcctgaattgctgtgggaagcaatattttccactgggaggactttggagcctagatagttatagcacccataaatcaaatcatcaagatttcacaaaagtagtgaggatttttggtgtttgttcccccgccccgcccccgcccacatgtaactgtgtggtgggggctgcctgtctagcatgtgtatcattagccttactcagaagtctaatgtgtgctttaatttaatgagatgcgactgcttgtgcattctctctctctgtttctctttctttcttgttttgctgttttctctagaaatgattccattaccaaaggacattattttcgtcattttgttgttgttgcaaaattaacatagaccatatacaatttgcaaaacagaagcatggtctgggtgggacagtgaagttcatatttcttgacataggcaggcaaaaaagagataagttatattacatgttgtattatattttatttttaaaaattagttttaagtttgcaggataaagttaattgagatatatatatattaatatgtatttgctgagcacatctaacgaagaatttatggcaggtactggggtgatagcagtgaactagaaagcaagagtccttcctttataggtctaggactaaaagaggaggtaagcaaaataagcaaataattaaaatgtaataagtaatgttggggagaaatatggagggcaatctttgtgggggagtgaaagatgtcatatttaaagataactgccaaggggtaggaataaaggagagatgtccaaaggcttcaaaagaatgtgttctcttgaaggtgcagagcaaaaccagtgtggctggaaaggagaaagaaggaaagggggcttcaagcaagatcatgtgcattgtcagacttcagatcatccaaggccttgtaagattaggggacttttttttttttttgcataagtcataaagaaatcactgtgggggaatcaaacactaaacaggtatgcaagataatttcagataaagtatatgaaacaaaaatgggatagagcaagtttagaggagataatgatgaggaatgtcctctctgaggaggtgacatttgaacggagacctgaatgggacaaaagggctagtggagaagagatctgaagaaagagcatttcaagcattagagtaaatagggcaaaaatcaggaagcaggactgtgctgtttgtttaatacacagaaagaaagaaatggttaactggaatttggactcgggacttgagttcaaattcaaagttatttatgctgcccccaaatgcgactacctaactgagcctgctgtttgctaaggattaggggctttctctgtttcactagatggtaagtacctgagcatagggaccatgtcttcccacttatttctgcaaacttagtatctgggccctgtctagtacctgttagactctcagtaaatattcattgaatgaaaacatctctacaattacaataccctgactgtatatctactgttaaaattctaagactagaaaaaaacaatttaaatgttgaaattcagtcagccaattggtaatttaataacccaactaaaaaaaaaaacccagaagacaaaatagtcaaaccatttctaagagtagctgcagactaaataacaagaaaagaaaaaaattatctaaagcaacgcttctcaacgtcagtgctattagcatttggggctgaataattcttggtcatgggagctgtcctgagcattatttagtggcatcgttagtcgctactcaatagttactggtagcattcccctcttgcgacaacccaaaatgtctgcagacattgccagatggccctattgagaacactggtatgaaagtattaatgccatgccactttctaaaatgttgcagaagttgttgtgccacccagtgggttttcagttgatttgtgtgcaaagttttaccaagaggtatgataaatatgtcccctgagttgaaatactgtgtatcgtacatgcattcttagcagaaaacaaagttgcttaatattttattgtttctaatggtttctgatgagacatccatcaatgtaaaagaaaccagtttcttctaagttttactttataaatatgtaatataattgtagagtaaacctcctttatcatcctgatggaggatcagactaatatctgtcttgagttttatcaggattttatgctatttttaaaatagtttgtggagggagggaggaggaaaaggtttgatatgcaatatgttaaaatctgtagaataacacagttccacttcatcaagctgtaccatatagctttcctatacagttttaataattttaaaaataacttttttctgattttaaatattcaaagaatatagtcaagtatacaagaggaaattaaaatcatctataatcccacaattgagagataagtatgtacattattctttcatggatttatttattcctccatgaaattatgtgccaggcactgtgctaaggctggaaatacatgagaacaagatatataagttatctccttatgtaaaacctacttgcatatatattagtgcatacattagaatgtgtattccacctttattcataccagaatcataccaggacacctagatagttcagtaatgctttggctggcaatcgtttggctgtcagtgaagaaacctgaaaaacattaacttaaacgttaaggatattatctcatttgcataagaaatttgaaagagagtcaaccagggctgatgctctgaatttatacttctatcgattactcaggatccttctggctttctattgtgccacttctaagcatggaaccattggttctaagcttgcaaaacagcttctccttcttaaggtatttctccaggttccagactggaaaagggggaaaagccaaaggaaaaaaaaaggcaggtgctccccgaatctgagctcataaaagagctttctccaaacttaagagttttctcaataacatccatttatatgttattgtttggaactatttcacatggaccccaagatgcaaaagatagaaaaaatagaacaaacttacattgagttaaaagtgatggacagccttccaaaaacagatgtaatccttgcctccttctctgaaataacaactaaaggtttagtatcagacttctagattcttgtctaagtgtagagagatacgcacaaaagcattgaggtcatctttccatccccattaaaaggggatgatagacattttcctctactcaacaatatatcgtgacaacttttcaggtcaatacatttagccataagtcatttagaaataattgtacaatagtccatgctatgagcaaatcacaattacaaaactgtcccatcgtaacatagattctctcaaaattattgttattacaaataaagcccagtacatctttatacggtatccttacacaaatgagtgactttttctgtagataggctagaaatagaattgccaggtcaatatgtgtgaagcatgtttaaacattctaatgggtactctcaattgcctttcaaaaaggctgtaattatttacagtctcaccaacagtagctgtgagtttctttctctcttcattcacaccgacaatggatattatcagtcttaaaagactggtaatgtttcctaacttttcaggcaataatatgtctccagatggatttatttccaaactgtttatataaagaatttcacatacactcaaaagtagaacaaataatataaactaagaatcccactacccgtcacccagcttcaataattaccaatatattgccacacttgttttagctgcacagaatttaatcatttttctatttttgctaccatcccttttttattttggagggaggcaggttgttgttcatcttttacttcttattctagtaagaattttgatttcctcataagtcctatgtatttgtcttaaagctcacagccatgcatcaagttttctgtctagtgcagagatagtgccatcactttccccttctgcgcctgggtagatagtattacttgatcaatatatcttttagctgtaagcccaggtgtccccttgcaccttttcttagcacagtgctttatacctatggttctcaaacttcagcatacctaagaatcacctggaaagcttgttaaaatacacattcccacacccaccacccccatagattcgcattcagtaggtctgggatgggaactaagattccattctacatttctagcaagttgccagatgacacagattctgcctatccacacaccatggtttgttagcattgttctagaccagtgcttccaaattttaatgtatatatgaatcactggagattgtgttccaatgcagattttcattcagtaggtctgcttctggccctgatatttagcttctctaataagttccaggtgatactgctggatcatagactaaatttgagtatcaggtcctcagtggccactactatgcagagttggttgtgaagtaaaattaatcagccatgtctaacctagaaccaaggccttccttgacctcaaagtttcctaaatatcattacatagactagaaccaggatagctaaaaaatattcaactgagaaacttttcttaaaactcagatttcaagtctgtgcaatgagaaattgtccttcatgagaaatttggggaggggtccaggaatctattctttatacagttcttttgccaaccttggagcccaggtaagtgtggtagccactactttatgcttcttggatgatgcacaggtgttcattcttggattcatctgatccctcacctaattattaatcttatcaagataaaaatgttgacactgactttttacatgactacattagatactgtgggtcatacagagatgaattagggacagattctacttctctagacctgataatctggtgaaagagattgatgtaataatacatagtcactactatgggaagtcagggcagaaaacctgtttcctctccttctcggtatcctccttcctgaaacttaaattaaaaacatttgctcaagaggaaatttcccatttcaaatagaaatctcataaaagcatagaaatgccaaggagatagttttctatgtaatattaagtcataatatgggctttgctcttgggtggcgttcccagatactagctaggtttgtaagtataacacaacatgtgcattacacagtacatataacagtgggaaaatgaatgccacctagagaaccataacttttgtcatttcttgactttggagaaatttcaatttgtagccttaatgatatacaactgtagatttttccattttaagtaatatgctgattggagtcttgcatagtgttcttattttcccaaattctcatcctatacaaaattcgcaaattcttgtattcccaaattatcatttctatacagaatgtaaaaattctaataaagctaatagtgtaggtcatatatttactgtctgctgaatggggctgttcactgtcattaagattctgaaagaagcacttgagaaaacaggataatggagaagaaaaagctgtaatcaagcataaaaggacttttaaaagggggaactgagacatctttcaacagtgacctttataacactgatactggactgagactataattgtccatcactcttttcaatggtcaatactctgctcaccacaactcattctttcaataccattgatccgtttaacaaccctggctggcaatctctctttgtaagttacaaagttagtgacatttattctgccctgtttggtggttcattgttaggcagtctcaacattgtatgtcttgatgagtgcagtctggtaagtgaattaggaaaattttcagatggtaaagaccgctttttaggcaggatatcatatggttaaagggaagcatggtataaaccagcggcttcacatcattacaaaacaaccctacctccacttttaaagaaattgaccatgcattgagtggacttttgttttttttttcccccttctgcacagtgggatgattagaaagattttaatttgaaggagaacccaaattatatcactttcatggatctaaaaatttgggtcacgggacttcagggattggagagaattgcaaagatggagatgcaatttgcttaagttgttccagaaataggaatcacatgacaataataaaactgcatttactctcaggataataaccagtttcttcagataagttcagatcttggttcttctcaactttgtgttcttaggcaattagtcttatcctctctgacacctaatctcgctactttttaatgattataacaccagtatctattttaaaaagtgttttagagaattaaatgagataatatttaataaacagtatttataatagtgttctttatgatggtatgcaacttatttcttattcctatggaatattcttatggaataagaaatccattaaatttctaataaaatattttacaataagttatcattttaattttttatttacattgttccttttgattcttacaacagccctgtacaataggcatgataaatcttttaactgaggttttatagataagtaaattaagtctcaaaaggttaaagggaagaatggatataaactgtcagcctcatacattacaaaacgacttaaaattccacaaaaagaaaatactataccatgttttttttgagattatctttataccatgttaatattttattttcagtgttttaaaaatcaggactgctgaaagcatggtaggatatcaagctctaggagtagttatttaagatagtttgattttgctgggcaccagtttccacattaaccttttttttttttttttttttgagatggagtctcactctgttgcccaggctggagtacagtggtgcgatctcggctcactgcaacctccacttcccaggttcaagtgattctcctgcttcagcctcctgagtagtcgggactgcaggcgcatccccaccatgctcagctaatttttatatttttagtagagacagatttcaggctggtctcaaactcccgacctgaagtgatccacctgcctcggtctcccaaagtgctgggattccaggtatgagccaccgcgcctggtcccatgggaagtttttacattgcgtgggatacttaaaagagtggatgcatttgtggcaccattattcacttttttgacttccttataataaaggattgatatttctgatccacagaagagagtggaatcattgttttagtccattctcacgctgctaataaagacttacctgagactgggttatttataaaggaaagaagtttaattgacccatagttcagcatggctggggaggcctcaggaaacttacaatcatggtggaaggggaagcaaacatgtccttcttcacaaggtggcagcaagaggaagtgctgagcaaaagggagaaaggccccttatgaaaccatcagatctcatgagaattcactcactattacaagaacagcagcatgggggtaactgccaccatgattcaattacgtcccattgggtccctcccatgacacatggggattatgggaactataaatcaagatgagatttgggtggggacacagcccaaccatctcaatcactttgctctcttttcattcttgatgacggtgatcatggacaacaggcattgcacacttacgacggatcaggcactgttctgagtaccttgtgcatccttgtgcataatccttccaatgactttgtggagttgtgacagtaaatgtgtcataaaaaaaaaatctctaagtaacagtaaaacacagccatttgtgtatgacttacttcttaatacaaaattaagagctttcaaggttccccaggcaatgtcattttaactaccttgcattctgatgcgttcccttgaatgtgagacaaggaagcacagttagagcaaactcatggagtccacacctgggtacaatccagggagtgtgttctgctccttggagaacatcgtctgagtatcatagcaaaatcaaggctgggaagggctatcctaaagcatcttgtctgtgaagagggaaattgctggctttcattctctagtgaatcaagcctgatgtatgcagcaattttatgtttaagtcccccaaccttttatttcaatgagatgatctgaagtatatcaaattccaggttaattgattccagatctgttcttgctaaactgttggtcagctgatccatgaaaggggccttggagcttgttatcagatgagctgagattactttctggtcctgaattatactagggtttggggtacatatcttaaatttctctgaaactcagttttattcataatacaataggaatccaaaggaatcctattgcataatattttactttatggctgattttggaaggtaaccttcctcattgaagctgtgaatctactatatttttaaactctcagaacaataaagagatgtaatttgctttatgataatagagaattaatacttaaaccaaataagtaaaccctgcacacaagcaggaatgcttgaggccattctgctatacttcctcaccctagaggtttgataactatgttaaaatgcaaagggggcaagagccctgaatctgcatatgactggagattcagtcttatagtctgacttttcttatagtctaactagctgtttctcaagcttcagtatgcatatgtattactgttttggattatacacaccaagtcaggtatggcctagtttgagggcaattaaaaagatttttaaagtaatttatgcataatttttatatctctaaatctaatacattcctcatcattcttgtaagataaaacaccatgactttactacattcctgggtgcatcctggccctgagcatttgcagtgagcgcttctaaatgcctctaagcataaatttccttttcagtaaaatggagtaataaaacccaccttgaagtatttttgtgaggacttaattagattcaaaattatatctacacaaaaggtcttagcatatgcctggcatattataagtatctagcaaacattacttcccttcctagctatcctacctcacaacacatcccacagcacaaagcagggatgggtaatcattcctgcctttaagagcatgtgtctgtttttatcagccctcagcttccttttatacattgcatggctgcataattggcaaaattttcattgattagttgaatcctcctggataaatggttgtgcagttttcacatcccgtcaagttaagtaaatgccataagtaaaaggatacatcaactttaaccagaagccaagacctgatatttcctgcaatggagaatgcctgttgctccttatgatgttatctgcagctgaccaggttgtcattaggcttttgatattgaatctgtgtagatacccaccttggccaagttattttgaaagacagaagaattaaatgagattggaatctttctctttctgtgtttttcgtccctactatccttaattgaacttctattgatgtcagaagatatcactttaaatagtaggcccctactaatgtttcaatgcttctgaaagttgttgggttattcttaattttcttgcatggatttgggaattaaaaatacatgctatcactgcaaatccatcagaatggccaaaatataaaagaatgataatattaagtgttgatgagaatgtggaaccaagggaactcttgtacatttttggagagaatgtcaaatgttacaatgttaaaaaaaactttttggcaatttgtaatagaatatatatctttcctctgacccagaaattctttcactaaacatgcatcttcaaaaagattgtccaatcatgcttttagcagctttcttcgcagtagccaaaattggaaactacctaagtgtccatcaataggagaatgggtagaaatgaactgtgctatgttcatacaacagaaaactgcccagcaataaaaaagagcaggccaggcatggtgattcacacctgtaaactcagcattttgggaagctaaggcaagaggatcatttgaggacaagagttcaagactatcctgggcgacatagtgagaaccccatctctaccaaaaaaaaaaaattgttttaaattagcatatgtctctagtatgctactgcaatcctagctactggggaagctgaagtaggaggattgctgaagcccagtttgtgatcagcctggaaaacacagtgaaaccctgtctctacagtttttattttaattagccatggacaattaaaataattaaaataatggcacatgcatgtagtcctagctactagggaggctgaggtgggaggatcacttgagcccaggagttagaggctgtagtaagctatgattgtgccgctgcactccagcctgggtgatagagccagatcctgcatgtaaaaaacaaacaaacaaattgcaaatgcattcaacatcatggatgaaactcaaaacactatattgagtgaaagaagcaaggcaaaaagagttatactttataagtccattgatatgaattgcaagaataggcaaaaccaatctatgctggtagaagtcagaatagtatttactctgagagtacctgatgaattgtagggacataaaggaactttctgggagggtgaaagtgttgtaagtgttgtaaatattgatctggatggtgcttatatatagatatgtaaaaattaatgaagatatacttttaagatttgtagattttactatatgtgcatatatgcctcaaaaatttcaaaaaacatatatatatagcaacatatatatatagaaacatgtatatacatagcaacatttatatatagcaactatatatatagtgctagaatagatttattaatataaggtaagatgtaccacagaaaattaatgactttatataaaaaaccttctgaatacccagtttcttcagcaaatatgtggcatgagaaaggggagtaagaagtaactgttacagattaaaaatgatttgagacatatcaatcacatgcaatttatgtggatttcgtttgggtcctgacttttttttaaatgtgaaaagatttttgagtgtgatcatgcaattgtcactaagggtgaaatgataaaagtaatgagatttgcattaaatatttcaaccaacaacgtgagagcaaagatatgaagcaagaatggccaatcattgaatatacggcccagacttatgaattaggagactgaaacattcagcacaaaaatagtagaccaggccaggtgcagtggctcatgcccataatcccagcactttgggaggctgaggcaggcagatcacgaggtcaagagattgagaccatcctggccaacatggtgaaatcccgtctctactaaaaatacaaaaattagctgggcgtggtggcatgcacctgtagtcccagctactcgggaggctgaggcaggagaatcgcttgaacctgggaggcggatgctgcagtgggccaagattgcaccactgcactccagcctggtgacagagcaagattccatctaaaaaataataataataatcataacaaatttaaaaaaattttttaaattaaaaatatttttttaaaaatagaccagtattaggtgagctgaggggtgagttaatgagtctacgttagtccacggggctatccaagagaaaactgttggctgtgtgagacaggagctcctcactgaagtctagcgtggagagaaagatgtcaggctctctctgaagttgcagccctgagtttgaaggaaatcagatcaggaaaatatttggaatggacaaaaagagctagcagaagccaagaccctcaacactcagagagtagacaaaggaactagagaccccggaggatgcaaagaaggattaataaggaagaattgagaggaggaaaaacacccaagaaagttaggaattgcaaaaaccatctcttgaatttcattcagaaagtattttctgagtacctgctatgtaggcactggaattgagttatggagaggtcattgctgacatcttcccgaggctgtcccagaggaatatgaggagacaagcacaaggttgtagtaatagagaataatcaagatacagagtattcactctaactagaagggtaagagagaaaacccgtacgggaaatgtgagagaaaaactctctattatttgtgctggtataacaaaaggagaccacctcaacaggacagccaggccccctgacatcaagctgttaacagggccatccttggtgctgtacaattggaacagaggctcatcgcacttccagcaagggaaacacagcagttgtggggcccccgcagtcagccacagcacaaagaaaaatgccagagaacagtcagttctcaggcctagaattaaaagtgatcagctttcatatttcctggggctctgcatgtccaagtggagaccctatttgccaagtctcggccctcagttaatttactttccttttgcttttccttactcctgaattgaattatcaccttcctgaaaaaccgcgtgtgtaatggaaaagcggacacaagccaaagtggaatatagcagcccaaatgtgactcccattatcgccctattacatgaggaactggctgctctttgcccttcgttcatctcctgctgactatgaaaacctagtccagccgctttgttttaatgtcagctgttctgctctgacctttgctgctccctcaccctcctccttgagagaacagatgagttccatttggggttgaagttattgtgcatgaaaatcaccgtaaggggcaatgagatttttttctttgccttcacaggacagggagcattaagcaccactctctgtcccttaaagtccagaagcgtgcatctggcaccctgtgagaaccttctcaccacactcttcagtcctactgacctcagttttgcatcatttctcctcccaatggctttaaaggtacctcctgttgcttccgtatgcattttaagtgttttaaaaatacatctgaggaaattattttaacagtggatgtttcctggcttgcattgcgcactatataaacttccaattagggctatttatccttccgtccgtgacgccccgaagcaaggcccatttgtgaaatctaattatacctccttatttgcctggattgaagaacatttttagatctttcaacaggcttacttctcaggtctggaggattttgctttttgtttttgttggggggtgggggggctttttgaaaatttttttctgagtaccctaaaatgattagatccattttgtttaatttttcttaaatatcgattttcacaggccactgtccaggagccatggtaaattcctgttagtgaagcgctttccttgggttccgaagcctcctttgctctcaattctcattactttgctctctggtcatgggtgatctcccctctcttttcatggctgagagttcacggctgtttctaatccagaattagcagaagtagaaaaatctgctccttgcagtaataactttcccacatatgctgctgctcactccgcagtgcaaaacagagccgggttccaggcccacgtggatccctgacattgccataggcgcaaaaagaacatttagttttttaagcagctttgctaaggtaaagctatccttgggcttgtatttgtgttgaattccaagaagtcagtgaaagcgaaatgagccaaataaaatgcagaatgactctgggaaacttccgtttcattggctcagcttcctggagaatttgcccatggaagattatgtcgccatttgcaccaagttggtgcagctgtttgtcaagcaaggctagattccctttgtttgtattcttacctcgcccacatttttaatgatgtctatcctctatttctcatccagacatttttgcctatctgctttcaatgctaatgtctctctgtcctgtttccaaattaaatatcatacttaaaatattaataccccttgttctttgattctttgtttattcgtcttatgcaaaacataacagtgagaactccatctgtattaaatgctactgtatgggcagattcaatgacttattaatgactgtttcatgatatgggagagccagggctttatataatcatgcaattcttattcaaaaatgctctgctagtactagcctgtagggagaaaaaatgaaatatgcctatcttttcaaagataaaaatgactagctttgtgaagatcattgtagaaataactaagttttgaaactaggccaagttacttcagtttccaaggaggttagctcatgtcttgaagtatttgggtacatacatttttgtagcatttattgaagtgaaaaccacatatcataaatgtacagctcaatgaattttcacaaagtatgtgaccactgcctggtgaagaaatagtatatttttaaggtgcctgttcatgtctctaacccatatttattagtttctgctttttaatacataggaattgtttatatacagtctttacatatgttgcatatgaattttctgttcattatttgtattaacaaaagcccactatataggttgcactttcactcttctaatggtgtcttttgttgactctaagtgctccattttaatgtggtccaacttacgactctttcctctatggttcatgtttttttgtgtcctattttaaaatctctccttatcccaaggtcataaagatagtctccattattattttgtagaagcattactacattcataattagagctacatctgcccagaaacatattttggtgttagtgtgagagtcacaggaagacactggaatattcttaggagaggcttatgggctagctgctattttataaagaccttcttctctgctttgtggaccaaagttgaagcaggaggaacatttagaatgttctgctgcactactcctggtgagaaatgattatggcttggatttgagtgaaatggcaatgagtagttggatgtgatctgtgttttagaaactgagccttcaaattttgcagatgaatagaatgaggaatgagggaagaagagaaattaagggtgtctccttgcttcttaatttcagcaacgggttgagtaatggtaatgttatttaagattcagcaggcaagagatttgtggagcaaactgaataattctgtttgctgaggttaatttcagatgaatcatttaagtggaaatgaatgaatggatgagtaaaccaatggacttgtgtaataaataagcaagtaagcggtagaactaggcacccaggtgccttgactcttatgcttaaaattaagatttttatccattatacaaatataacccagataatattctgttgaactttagtttcatagtatcatggaaaaataaagattccctggtcaaataatttggcatatttgatgtaacaaccctcttgataatttactgtatatattacttatgtttctgagaaattctgcaggaaaaagttacttctttagctttagttaacccaatatttctcaaatttatttttccataaaagtgttcttaaaggaagacctgcaaacgtcacacaatactagtattaatgttctatggaacaatctttgggaaaaactattattcaatctactaccatgttaacatgtaaaacactacccttaaaatacacaaacagtaatcattattcttgttcacatctgtctatttctgtaattttatatgagtagtgaatgtcttttaactaccctttctcaagggcagttcccccatgtcataataattgaaaattaagaagttacagagtcataatgaaattgtcccctttgaacctttgttgactgaagctgcatattaaccacatcccattcagaccaggagtaacaagaaatattctgaaccccagctgctacaagataacaagctttgacagcttcctaattaccttactatcctatagttaaaaacactttaatactatagcaattctcttctcttcacataagtcaaaagatatatctaattttctccttaattgatatctgtattgctgctttaaaaagaatgcactcctccaatatgtttaactattaatttataacctttgatctgaatgtgggaaataattttaaaaagaaattacttgttatcaactgtgaatagataaatctgaaagcctcagctcaaagtggatttaatccttttcttaaaaaaaaaaaaactcttttttcctcaagatctaactttctatttaataagttcttgcatgttttatttcactctgctaagctttattttttttcacctgtagaatgggggaaaataacagccttagtgtcactgtgaacatcaaataaaaatgatgcatgtaaaaggattagaacaggatctgacccatagaaaatattcaagaaatgttagttctatgcacctcagttatgaagatttttggatctgacagcaacatggactcaatatataggtgttgaatcgaaataacttcagctcacattaaagtttcctttattacgttaatagaataagagatatttagagctagagtctcggactgtaagatgttgtctaggcccaaacacaattggcagtgcaactgtgaacaattgatggatctagaaggcacttaagaaaataatgttatagtatttacatattttttttacatgcccagtgctttgttaaaccctttacaggaatgatctcagttaatccccaaaacaaggtgagtagtattgcagatcccatttacaacaatatattaggtctagacttacccaagaccaaagagctattaagtggtggagggagattttgacctaagactgtctacatccagaacttatactcttaactactctacatactactgttgacagaatcttgtgaaaacgagtcattgtataaaaaagggagcgaaggccaaaaaacgatccacacgttaaggtagtgcagaatcaatataacatagaatgttcattccccacaaaaaaaaaaatctggatcatgttaaaaaaattttcaaagtattttgaatcaaaatgttatttatgtccctaaaaccacaaatcatgctagactgaatactcccttccaaataaatgcatgcttatttagagaatcctgggtcacctgccatacaagggataacagaaatgaaatgctttgtcctgtctttaaaatctaatcatctagtgggagataatacagtataaggcatctgatattttctttataaatatctgggaggtggcttccagaattggagaattttacaccaatgtagtaaaacatatatataaccacagttttagctaatacggtttcagttttcactcatgtcgtttactctctcatcaccatctcccctcctagccaaaaatcaacctagacatcaattatgcttttcccctcacatattccattagatgttatctactctatacagttaagcatatttagaacatttagtttacctacgtatatataattcttagtagctgtgtcttatctacccagagatttaaggaaggacaaggcatctgtcctcttttcccagaccatcttctttatggcttttcctctcagtcttcttttacttatttaccatacgtactcccattgcttgagcccgacagatcgaggctgccgagagctgtgattgcaccacagcaccccagcctgagcaacagagtgagactctgtcaaaaaaaaaaaacaaaaaaaaaaacccaaaacaaaaacaaaaacactttttaagattttcatttacatatgttttaggtttcatgtaagtgttttcataatcgtttgcctctttcctttctttttctttttaaaagacaaggtctcactctatcgcccaagctggagtgcaatggcacaatcacagctcaccacagcctcgaattcctgggctcaagtgatcctcctgcctcaaccttccaagtaggtgggacttcaggtgctatgccaccacacctggctaattgttttgttttgttttgttttaactttttggtagacagggtctcgctatgttgcccaagctggtctagaaattctggcttccaaggatcctcctgtcttggcctcccaaaatgctgggattacaggtgtgagccactgtatctggcctcttttcattttgatcctgtgacagctactagaaaaacaaacaaacaaacaaacaaaaacaatcacttccttattcttatccacaggttagattaagaggcatttcattgattgcttcccttatattctctcatgaattctcaaaagctacgtattcaatcctgtaccttttttagactgttagtataaaaggatgactttaaaaaaaaaatgccttaggtttgtactaacagctacaaccttctagctgaaaagttcactgggagatttacctctgtaaaccaaaggtgtctaacccttcatagttgatgagatgctttaatagtataatgaaagtatagatcctctccccagggaaaaataatcatatgctggcagcatgttgaaatagcatcaggatcttcacatgctttctgacattcacccatggacctcagattaagaatctctctagatgatgggttgataggtgcagcaaaccaccatggcacattacctctgtaataaaactgcacattctggacatgtatcccagaacttaaagtaaaataaaaatagaaaaaaaaatccctgttgtagatcaaccccatcagttatcttggggactgaattaagtgtaatggttaattaagagtgtgtactcaggatcaaataaacaaggactcaaaccctattgtcacttctttctagatatatgatcataggcaaactgtataaccagtcctgtgattaatagtagcatctgcatccttgggtctctgtaagaattaatgagatattgcatagatcaggacttagcatggtgcctggcacatgtgcttgatcaatgcgagctattgttctcttcataacgcatttgtatttaatatcttaggtttttcagcagaaacagaagtcagggcaaagaagctggtctttggagacctttgggggaaattgaagagcaatttccaggtcgagaactgtggtgagaaaggcccttttgatttcattttgaggcccactgagggactgctccgtctatccctcttgtgaaagaggtcagggagaaaagagaaccttgtcaaaaaacacaaagaagcagaacttgatcaaagtgcagagaatgtctctgcaaagctattgattaagatttaggattttttgttcatttgctgtgaaatgcactcagaggaacattactaaaacatactctcagcagttaaaattgcctctgatttgatgttttcttgagtccttctttattttagggaatattttataatattcttcactgtcaaattatgtaataaacaacaacaataattcaaaatttaattttctatgcacaattcttccattggtcaaggaatcgaaaggacagtgtaattccgaacaacactgcccaatataagtaaaatgcaagccacatatgttactttaaattttcatgtagccacattttaaaaagtaaaaaaaagtgaaattacttgcaataatgtattttatctaaccaaatatatccccaatatcattttaacatgtaattggtggaaaaatttattaatgggatattttgtatttttaattttataccaactcttcaaatccaatgtatctatgacactttcagtgtatctatattctgacaataaacgttcaacagtaaaagtaaaatgcagttctgccaaaacgattaagtcacatttagagaaaaaaatgttttatactatttccatttttcaatttacatttaaataagattaaaaattcagctcctgggccaggcatggtggctcacatctataatctcagcactttgggaggctgagatgggcaaatgacttgagcccaggagttcgagaccagcctgggcatgatgaaagcccacctctacaaaataaaattagctgggcatggtggcacacacctgtggtctcagctacttgggaggctgaggtgggtggatcgtttgagcctgggaggttgaggctgcagtgagccatgatcgtgccacttcactccagcctgggcaacagagagagatcgtgtctcaattaaaaaaagaaaaaatttacttcttgaatcacacagccacatttcatgtgtacagtagccacaaatggccaatggttatattaggcagcaccggttcacagggaagaatctgaatttagagtcagaagctctaggtgtgaacttgcttctcccatttgctctctgtctttgcacaattcactatgttctctaagcctcagttttgtccccttcgctcaacctcctgagccctaacagttgaatgagataatgtgaagggaaagggcccagagaactgtaaaatgaaatgtaaacataaggtattttaaatttaataatatggagagagttaattatttagggattttgaatcagattccacgacatttgtggaggcagaaggaaatcatctcctttaagtattgccaatgatgattataaatcctaaagttaggatgcagtgggttggtagctttttaaagcaattctttttcatactttgttaggaaaatcagtgcttttatcttgactctaagttctaagacctattttttcagttaaaaaaaaaagactttttaagtctatttaaaaagtttaattgacaacacagtcttagtgctgtgtgtctgtgtgtgtgtgcatttggaaaagaaacacacaaaattctcaagcctatttaccctcacagagaaagaaggaaaggagagagacttgttttgcttcattgacttcactggtgtttcagttttgttttattttcttttttgagacagggtctttctctgtcacccaggctggagtacagtgatgtcgtcataactcactgcagcctcaaactcctaggcacaaacaatccttctgcctaagcctcccaagtaaccaggattacaagcatgtgccagtatgcctggctaattttctttctattttttgtagagacagggtcttgctatgttgcccaggctagtctctaactcctggcctcaagtgatcctctctccttggcctcctgtattcctggcattataagcatgagccttctgagtagctgagaccagctatgtttcagttttgaacagaaagatatgtattatttttgaaataaaaatcagtgtagatgaaaacaaaatcatgttatataagataaagagctttgattctctgtcgacaacagataaagttaatcttctttggaaaatgagcaccattattatacatgagaattaatatagacaaaccaataaatcatagctacttctcatcagggatccttgctctagagaattgcctatgtgagctacaactttaccaaagtcaacaccagcaatctggaccgcctaccctcgtgactttttgtttcggttcatatttgacatccatattgttgtttttatctacagccttttaaaacatgtgacttgtctgtccacatggtatcctgttgaatttcagttttagcctctcaggagaattactgcctgtttggttgaattgttcccaagagccccttaaatgaatttctgtcacatatcccttgaaatctctatttagatcacataatcctaaacatacccttggaatatgatacaaattcatctaggtgttttcatgctaagcagccacagaaagatagaatcaacttaatatatttagattatccttaaaaataatacaaggtatcaagtgatttttaggggctcaaaaagatacttactcaaaaaaaaaaaagataatatctcctgcataggcccttaacaaactggcttttaggtctctcttgaagtgactagtctctatggatacacttcctgtttcaacatacaagctgcccacttgtgtgcccttatattaatatacgtaataattattgaaagtgtaccatgtgcagacactgtgctaggtgcttgggttacaatggtgaaaagatacagacatggctgctacccttaacgagcttgttatcactggggagacctgttcatcaaataacctaatggaaaaattaacagtagtaaatagcacataaaggtgggaaaaatgatgctggagtgtttggggaaagtggcctaattggagatgtcacagaggcttctataattgaactgaaacccaaaatatgaaagagtgttaaccagcccataggagagaagaagggtggatcttgcaggtagatggaacagcattgttctgaaaccctgaggtagaaggtaaaataggacattcaaggaggtcagagcaagcccaggtagctggagattagaaaataagcaggtatataacacaagatgacgctgaaggggtagtagggtatcagaccttgcaaaacacagtagaccctgtcaccaatggtgatctttattctaagtgaaaccaaagtaagtacccatttgattagggtatttctcttcattggctaaggttgtagggactacttaaagcattaaagcatcactagcctatctttaattttctacagaagccaacagttagcatggaacattcctaagtcttcagaatagccactctcaattctgggtcttcaccctgagcccctgggaaaatttacaacaaatttgatgacagagacaccacagctacccccaaccccaattcctagagattctgactccacagatctagggtgggacatagccatcgttatcttttaaacattcggctagtgattctgatgggcaataatgtctgggaactattgcattcaaaattcagttttgtgtattcctcttttaatgatagatattatcaacctcagtgaagtagataatattattggtcatttttgaaaattatttaatgaagaggaaagtttacagcaagatcttcctctcctgatatcagtgggatttctgatcattcattttttttttttacatttttggggtcttctgtattaagaatatttctatatgttcatattccttcttttgctttcctccttgtgaaattttctttgtaagttaatattctatttattttgaaacttaattagatcaattattacaacaagctcagtaagtctagcattttccaatagtgctatatttatcttgtttttcactcaataagaacttactgtgatataatgctttcttgcaattgatttaatttatactttctgaacacttcagaagtaatataacagtgtttccctctcagacaaaattgtttccttgcacttggagatgttttccctgtccattagttctttttcatccattaggcagaggaaatgtctgcacttcctttcatcttccccagtgagcctgtgccctcagtccctgatgaacacagggcaagctaatgacaccccatcttggtagcagccagaggtggacactacttctagtggagccacttagatatttcttgcaggagtttgaactagggatccaacatattgaattagttgatttggactacggaagtgagggtccatgtaggggctgaagagactataaataaccatggacaggtgaatgtgtgtgtcatgctgagaagccatttggggaggggacatcaaaagaatgaaatgaaagggacagaaaaaggaggacattgaaagggtttgcagcagtgatcaaaaaatcttgtagctaagggagtggaatccataaaaggagggacaaaaacacttatatggtttagctgtgtccctacccaaactctcatcttgactcataatcctcacaatccccatgtgtcaagggagagaccaggtggaggtaattgaatcatgggggtgttttcccctgtgctcttcttgtgatagtgagttctcacaagatctgatggttttataagtgttaggtagttcctccagtattcattctccttcctgccactttttgaagaagatcccttgcttcccctttgccttccaccatgattgtaagtttcctgaagcctccccagccatgctgaactgtgaatcaattaaagctctttcctttataaattacccagtctcagatatttcttatagcagtgtgacaatggtctaatacagtaaattggtacctaggtagtggggaagtgctagaaagatacctgaaaatgtggatgtgactttggaactgggtaacaggcagagaggttggaacagtttggagggctcaaaagacaggaagatgtgggaaagtttggaacttcctagagtttgttgaatggttttgaccaaaaatgctgatagtgatataagcaatgaagtccaggctgaggtggtctcagatggggatgaggaacttcttgggaagtggagcaaagttccacatgtccaggatggcacttcccactcagagaatgcctttggtctctcccattagattttattatgacctcttcatacagagcatttccaaaagacagctaagttactctgaaaaataaacaagataaacagccctagctatgctttagcaaagagaagggcagcattttgcccctgctctagagatctgtgaactttgaacttgagagagatgacttaaggtatctagcagaagaaatttctaagcagcaaagagttcaagatgtgacttgggtgctcagttttacgtattcacaaagagatggtttggaattggaactaacgtttaaaagggaagcagagcgtaaaagtttggaaaatttgcaacctgacaatgcaatagaaagtaaaaacccattttctgaggagaaattcaagctggctgcagaaatttgcataagtaaccaggagccaaatgttaatcatcaaaacgatggagaaaatgtctccaggccatgtcagtggtcttcacggaagtccctcccattacaggcctggaggcctaggaggaaaaaatacttctgtggaccaagtctagggctttgctgccttgtgcagtcttgggacttggtgtcctgcataccagctgtggctaaaaggggccaatatacagctcagaccactgcttctgagggtgcaagtcacaagccttggtggcttatttgtgttgttgggcttgtaggtacacaaaagtcaagaattgaggtttggaaacctctgcctagatttcagaagatgtatggaactacctaaatgtccaggagaagtttgctgcaggggcagaaccctcatggagaacctctgctaaggcagtgtggaagggaaatgtggggtgggaacccccacttagagtccccacgggggcactgtctagtggagctgagagaagagggtcaccatcctccagaccccagaatggtagatccattgatagcttacaccatgcacctgggaaagtcataggtactcaatgccagtccatgaaagcagccaggagggggactttaccctacaaagccatggagacagagctgcctgaggctgtaggagcccacctcttgtataagcatgacctggatgtgagacatggagtcaaaggagatcatttggggactttaataatgactgcccaggtgtaattcagactggcatggaagctgtagcccttttgttttggctgatttctcacattagccaaatgtgagaacaaatggaaaaagaacatttacccaatgccgctacccccattgtatcttggaagtaactaaattgcatttgattttgcagattcctaggtggaagggagacttgtcttatctcagatgaggctttggacttgggcttttgggttaatgctggaatgaagttatactttgggggactgttaggaaggcatgattggttttgaaatgtgaggacatgagatttgggaggggccagggcagaattctatggtttggctgcctctccacccaaaatctcatcttgaattgtaatccccataatcatcacgtgtcaagggagagaccaggtggaggtaattgaatcatgggtgcagtttcctccatgctgttcttgagatagtgagttctcacaagatttgatggttttataagtgttttctagttcctcctgcattcatttcccttcctgccaccttgtgaaaaaggtgccttgcttccccttccaccatgattgtaagtttcttgaggtctccccagccatgctaaattgtaagtcaattaaacctctttcctttataaattgcccagtctgaggtagttcttaatagcaatatgagaacagactaatataataggtctatggaattttatcacatacacagaatcgtgtaaccactaaacaaaatatttagcacctttagtaaaggtaatacattcacatggttttaaaaaacaatatttaaaaaatatttaatgaaacatttcaatcctaaccccacccccaatttatactgttccctgtcccattgtcacttttactgttttcttctgttgtccttccattaattctccttgaaaatacaaagcaaaattaccatgtattataaacttcatcctccttatgtaaaagttatctcactacataaatttttctgcacctatcttcatttatcttgttggagatcattttataccctcacaaaatgagcttcctaattctttttataggtgcatagtatcctgttatataaaccctgcacctttaacttgcttgagcaatctttgagtggttttttaaacttagaaactcaagatacaatatgtctcacaaaacaagagtctcagtaaagctcaaaagaaggtgtccaaatgtggacagtaaactctggcaagtttaccagatggtgaggagtaaagtggccccctgtctggaactgggaaaagtaaagcagagctaaaagcagaaagtacatctctctgcactgaaaagatggatttttttttaagtcaaacagaagagcatctgaactatttaagataatgaggtcataactgagttaaaaactagcattggagactcagccaatactctaaaaactgtcagaagtcggtcagatgactgacaactggtgcttatgtgggaaagcaagaaagaacatcatttcactgtctagaccaagttgaaagattgtgtttcagaatgatagcattgattgaatgtacatattttgggaatatattttgttttggtaagtttattcagttttatgttcttagtttatttatatttgtattcgtagttcattggtagatttattcagctttttagtcttagttcattttatcctagttcttttgtattaattactcatttttatatcatgttattttagcttttgataaaatgatgaaatattatataagtatttgataaaatgatcactacagaagatcaggtgttttcttttgccctaatttaggaagagagaaatatttgtagttggaatttgaaaggccaaagtaataattacattaaatcttaattcattaaataaaactactagagatagagaggtgtttatttccaggccagtccagtgacctctaactgctttacagactccaacagttcccgagaaaggcagttaaattcagtgactatttactgaccatctcttatgtattaaacaccatacacatgtccagaatggcacttcccactcagagaatgcctttggtctctctcattcgaatttattatgacctcttcatacagaacgtttccaacagctaagctactctgaaaaataaacagttcatatgctaatagctggtaatgacaatgaactcccccagctatttgtccattgcccttttcttttcttgttaatctttctttttttttttaattttgaatctttgttctcttattcataaaagttccaagagaatggagtacttgtcttttccattgttgtatcctcagcatctaagacaatgtctggtatcgaaggtgctaactaaatacctctggatgactgggacacaggaagcagtctctcctacaggaaatacctcctggccagaagtatgggagactggaatgctcatccccacttggacatttgctaactatacaaaccagcaaggaaatcattttccctaagcctcagtttatgcattgataaaatggggctaattataaaataaagttcaaaataagggttctagagccaaaacacctaagttctatccaagttctactactaactgtccatgtgtgaccttagccaacttgaacctctgcgtctcagttttctcatttttaaaatgggaaaaatattagtaatctacctcataggattgttgtgatgactacatatttttttcaaagaagtatatgtcaaggtgcctggtacataaaaaatgctcaataaatatgacccacttctattatcagcattattgtgagaaatcaatgagatgtcatgaatgaaagtacttttactgtataaaaagctacacagataaatatttccagatttccatgttaccctgtcaaggacaaacatttgtcttctagcaggaggcttctagaaccacattgcttttaatcgaatttatagatataataaagatccttccaaatgatgggatagtgataaaggcagattttacaaaggaggagcttttggttgaccataacataacacttcaaaaattagccatttactctgcctaaagaggaaacaaaacaatgatttttggcccaattgtccttgttatgaaaattctttttgtttttttttgagacagagtgtcactctgtcacccaggctggagtgcagtagcgtgatctcagctcactgcaagctctgcctgccaggttcacgccattctcccgcctcagcctctcagcctcccgagtagctgaaactacaggcgcccaccaccacgtccagctaatttttttgtatttttagtagagacggggtttcactgtgttagccgggatggtcttgatctcctgacctcgtgatccgcccgcctttgcctcccaaagtgctgggattacaggcgtgaaccaccgtgcccggcctgaaaactttttagaaggattaaaaatatgtcacaaagaggcaaatttattaaaggaagccactgatttgctgacatgtattcgaaaagcagccaggaaaccgcagcccttttccttatcaaaaaaaaattaagagaaaaataaaagctttttatttacttgtgttacactggaaatatactcactagaatttcaaatattagtactgcacccaccatacagtgcttgcttaacaaaagtagacattacattagtggaaattgaagtgtagtaatagttttatccacaaagagtaaggcagagctatttgaaaatgatagaaatctgaaattggatatttaaatgtgggaaaatgaaggtgtctaaaagcatgtgaaagtattctaaccatattttcatcctgttgcatattaaaatagaaaatacacaatagctgtgtgatttaaatgatatatacttgatatgaaaaaatgtaaaggagaaggttgcatacagaagaaatcatccaaaattcaaaatactagaaggttttatttgttaaagcccaggttaatacaaacaaatttgtaaagtaagtacagtgagaaatcttctttgtaaagttttctttatatttgaacctagcaaaaggtctttctggctataattttacctttctagtatggctatatttttcagtatggaagatttttctaaataatctgaatgaggggtgtgatttgaatctgtatcatgttctatgcccacctcccatcttgggatattgagatgctcaaaaagtttgcagatgttattttattcctggaagttgtactaataagtgatagccattcctatggtacctaggaaatgagataaattctttaccattgtttcagactattatgttcaaacagccactgaaatataatagaaaaatacttaattacttagagaagctaaagagtgatttggcaaggtcagagttttaaaatggagaaataagcaaataaaattctttttaatgctagttaattatttggtcagttggtaagaggaagtaaaagtgaagttatcacggaaaatgttgtccaaggaaggtttatatagttgtttagttgggtgttttcatttttcgtgtgtgttttagtgggccaggcaaaaggtcaccccagtagaccacatagtagctgtttttatcaggatagctccattttacctctcctcctgcaaactgcagtaaaaatagaatatgaaataatgtattagttccctaggatggccaaaactaagtaccacagattgggtggcttagcacaacaaaaatctactttccttaagttctagaagctggaagtctaaaatcaatgtgtctgcagtgtctctgggtagcatccttccttgtctctttctagcttcaccaatcctcattattccttgtctttcaggtgcataactctagtttctcactctgttgtcacatggtgtttttcccatatgttttttttcccccgatgttttcttgttacatagccaccagtcatattggattacagctcaccctaatgacctcatcttaatgcaattatatttttaataacactatttccaagtaaagtaatatataatatatgactatatataaatggctatatatatatgactatatatgactatatgactatatatatatatatatatatatatatatatatatatatatatatataggtagaaggggttaggacttcaatttatcttttggggagacacaattcaacctataaaggcttagggtaagggagaattccttgaaacataattttctagagtagtaatcattttagatctctttagatctctgggaattatagggatacactagtaaatttcctagctagagtaaataattaaaagattctccagtggggtgggggtcaggggatggaaagaaagtgccttatacctctagtgggttttcaagtatcaccaagggaagaggatatgtaataggaatattgagaggcatcagtgaagttgttaaggacaaaaactcaagagccaaaaggctggttcacaccctgctccaccacttctagctatgtgaactgtggcacattatttggtgactccacacctcattttcttcatgtaaaatggacatgataacactacaaggcagctgtaagtattaaatgagcaaatacagcacctagaataatactttgtatggtgaggcatagatttaaaatgtttgaaaaacagtgaattggagtaagttactaatgaataccctttggtgattgaaaagacagaggaggaaaaaaaatacaaaaccgtgacttcatgcaagggctagatatttgaaactgttattgcagagaaaatacaaacaagggagcttcagattccaaaaggaagatcaggtgttaggagaatactagagttggttaaatgctacctgataattgtctagtgtgtgaccttcatggtctttacccaggtagttgtatttctttaaacttttattacattatagctttgtacctcctctttattgggtgggatttttttccagtgggattagtgcctaaggggaaataacacgtctctctttgggtttgaccttgcaaaaatttaattaagtgacagtaattatcaggctgttattaactttgaaacatctaaggcttgcatgctaccctagagggtttgtctgagtttagttttcacatattcagaaatattctttttaaactcacatatacagttgtgcttgtgtgtgtgtgtgtatgtttaaatttacatgctgtcaaaaatagattttgactgaacagtttcaatttggtcttatacaaatttgttgagtgtcccctccgcctccacctcctggatggatctggatctccgaggagctaaagctggtctctggaactacattatgtaaaaatctgtcccaactacagtcatttgtctctgggtctttggactgagatgtggtctcctgtgggtaagccacctaggttgctatccatggtgctgaatctcccctacacaggagcaggggtggatctttctctaaagtgtccacattcctgtaacagcctcataccatgtttcccctgagaccaattatagcttaattctcatatttctaatgactttctgacaaatacctacatttcttttctataaacttttactaaaatttcaaaacatcaaaacctgtagtgtttttgaacatgatctttgactccagcaaggactagtcaaatatcagatccaccatatgactctggaaatccatgtaactaccattagcttctgttttttcatcaataaggtgtgaataatgatagtattgttgggataatgtatgttaagaatttaatacattgccctagcccatagcagtgtgcctaatcagcatcactaaatttagctattatttctcattacacattttctaagaccaaagtccattttataatacaatgatgaaaaaagttacttagagtgtttatttgtacctcatttttcgaaagttggaaattattttattaacttaaataagaattatttgctcaatcttgggattcaaaatgagaaagagatagttcaaatatattttttctagcatcccattgctggtctagagtggtcttataggtaaagtaatcaccaggtatataaatacagactagctccaaattctacacatccagccatctgatatttggatcagtaacatctacattcagcagtaacacttaactacatacatgaataatatgacatgttaattttttcaaacttactgtatatatggctttgtccagttcttatttgtggttttattaaagatttgcctctacttttttttggaaacaatatttatattttatctctactatgtgattgttactttcgtttagctgcacagggcaaggcacttgaaaaaactggagatttaaagttctctagactcctttcttgatttagcatattagtttcatctggagagtttaagtattcatgagaaggtgggttccaagaactagaaagacataaggggtgagctccatgtgagaaggtgagctgaggtcaggattagttatatgtaaagatgcataagaaatggctaatcagtgtgcaagagactcataactgcccttgttacctcactggtttctaatatgactgtttaagccttcttaagtgttctgaaattattatatatttttaagacaaaaatgctcatttttactattgccaagtgttgaataaatatgtgtaatcactccccaaaatgccaagcatagtaataaatcgggtgacataatgaaaattttacttcctaatttgaaaaggagcctcaaaatgatggagcattcatgtgctaaaaacctatgatttataagccaataatattgtatgaattcagaggaccccagaaggctttatactgaaggtaattgtcttatatacactgcttgacatccaaaatttcactttatctgttgcattctgtcttcattaaaatgctatcacccctggagtggtcatactgtaagctattgctctttcattttagttttattaaaagttatttgtattcattttataataaattagaaacacttttgctactactatttcttccctatactacctgttacctgtcttagtgaatttgctatctcttgtacaggtctattacccagaatagatggcttagtaagttgatgcctttataacaaacaattcagagggacaaaagcttcttataagtaccacatgctaaccaattgcaccactggagccacaaaaaaaaggcttcttatttactactttgttcatgtaaaactacataatgcactttatagtcaacaataatgaggttgttttcatcatcctcctcctttacacttgcatggaaaatttgtcattctcatcaaatgatttcatcaggaatataatgctcatttattttgatcatatgcttattaatgacacagagaaagagatgctattacaaagtggtgaatagcttgtcccatctcatacacacaaacacacacacactcactcactcacctaaaagtagcaggtagttggaaagctttggtttcactggaatagtatcttaatttaatattctagcctacacagcttgaatgatcttcttccttcctactgctccaatctttatcaccttgcttctccagtatgttaccgttataccagttgcttcacatccctagaagccaagctggttcctgcttcagaaaccttacccttgatctggaatgctctcatcacagatctgcacattgctaattcttcctcatcacttatatctgagctcaaaagtcttcctaattcaaggtttaccttacccctggtactctgaatcccacaaccctgaaagctctgtaaaagtgaaatatttgtctattctgtttaccactggatccttagtctagaacatacaaagcatacgataggtgtccaagacatattttctgaatacaataatgaattataaaatacaaaagtgaaataataatcaattataatatgcccaaagatatctagtaccttgaagggataaggaagaaataagctataataattattgtcacttactgaacacctacaataatcaaggtattatacctcttacctcatttaatactaacacgaactttgtaccacagcactaataaatagccaagagaaaatttaacccatgtctatcctattacaaagccatgtaattagacattgggcacaaatattggaagaagcccagaatatttacactgagagacccaaatacagatttacctactagcacttttctatttggatgttggaaatagctatttgtgcatgaataattttctcaggatttgtatcatttaggattttgttggcagtggcagaagctgccacctaaacttacttgagcaaaaatataaaataagtaaatgtattggcccacagagttgaacagatgggaaggatggcttcaaagggggctcaacatggtcctcaaatcatgtcaccagaacccaggttctctcttgattttcatacttcacttccttggtgttaatatggcaggatgttagttctagcagctgcagggattatatattcctttatgtcagtgggaaggaggaagtttgcttccccagtagtaaagactactgccagcccacatggcacttttgtgcaaattgcaaaaggtaaccctttctcgaggaaatttccaaagttagtttatgattaatttatcaataattattgaaacttatataagctactctacaaaattatacaaatcatactgttagaagtaatatagtagaatatgtaaatttttaagattcaagtacactcatattagatgttacgtaaaaatttcatgtctttttttcaggaaaacaaattatgatactttaaaagcttacttgtaccaataaccaaaccatagacttcaccactttttctagtaggaatggagatcttaagtagtttttgtttaatttttagaagcaaaggtctcggcttctcaattaccagtatcagctaagtcaagtataccctaaatatttttaaataaaagtgtttgtaattttttctggtgaattattgccatgaatatttcagtacttcaacaagagatgttctaaatctaagaaaactatgtataagttttagttcctcatgttcctgatgttcccccagtatcacatgactatattccttggtaaatttccaatttatagtttatattgttgaagtagttcatattcatattcattacaacttttcaaattataattcatataaacactatcataaacttgaatcttaaaggtgatatatgttaatgataaatatagtgaaaaaagaaattcattttaaaatttagttctggataatttctatgatcaatataatcatgctgtttatatttgaaataatcatgctgtttatatttgaaatgagtctaatattttctattctggagaagccaatgttaatgctaaaagatagtgaaatttatttagtttcaattgtgtggtttttaaaatattgcttcatttttattcagagaatttttttttagtgctgtcaagtgtttacgtatgctaaattttggttgcttattatattagtccattttcatgctgctgataaagacacacccgagcctgggcaatttaaaaagaaagaggtttaattggacttacagttccacatggctggggaggcctcacaatcatggtggaaggcaaggaggatcaaatcacaacttacatggatggtggcaggcaaaaagagagcttgtgcagggagactcccatttttaaaactgtcagatctcatgagacccattcactatcaagagaacagcacaggagagacctactccccactgccatgattcaatcgtgtcccactgggtccctcccataaaacgtgggaattatgggagctacaagatgagatttgggtggggacacagagccaaaccatatcattctgcccctggcctctctcaaatttcatcaaaaccaatcatgccttcccaacagtctccgaaagtgtcaattcatttcagcatttactcaaaagtccatagtccaaagtcttatctgagacaagccaactcccttccacctatgaacctgtaaaatcaaaaacaaggtagttacttcctagatacaatgggggtacaggcattggataaatacaaccatccaaatgggagaaattggccaaaacaaaggggctacaagccccatacaaatccaaaatccagcagggcagtcaaatcttaaagctccaaaatgatctcctttgactccatgtctcacattcaggtcacactgatgcaagaggtgggttcccatggtcttgggcagcttcacccctgtggcttcacagaatacagcctcccttctggctgctttcagaaactgttgttgagtgtctgtgggtttttcaggtgcagggtgcaagctgttggtggatctgccattctggggtctggaggacggtggccctcttctcacagctccactaggagtgccccactagggactctgtgtggagctgtgaccctacatttcccttccacactaccctagcagaggttctccatgaggggcatgcccctgcagcaaacttctgcctaggcatccaggcatttccatacatctgaaatgtagatggaggttcccaaaccccagttattgacttctgtgccctgacaggctcaacaccgtgtggaagctgccaaggcttgcagcttccaccctctgaagccatgacctgagttctacgttgacccctttcagccatggctggagcagctgtgatgcacggcatcaagtccctaggctgcacacagcacggggatcctgggcccagcccaccagaaccactttttcctcctaggccttcgggcctgtgataggaggggctgccctggagacatttttctcattgtcttgaggattaacctttggctcctcattacttatgcaaaattctccagcaggcttggatttctccccagaaaatgggattttcttttctatcacattgacagactgtaaattttctgaacttttatgctttgctttccttataaatctgaatgcctttaatggcacccaagtcacctcttgaaggctttgctgcttagaaattttttccaccagataccctaaaccatctctctcaggttcaaagttccacaaatctctagctcagggacaaaatgtcactagtctctttgctaaaacataggaagaatcatctttacttcagttcccaacaagttcttcatctccatctgataccacctcattctggactttattgtccatatcactatgagcattttgggaaaagccattcagcaagtctctaggaagttccaaactttcccacattttcctgtcttattctgaaacctctaaactgttccaacctctgcctgttacccagtttgaaagtctcttccacattttcaggtatcttttcatcagcaccccactcatggtaacaatttattgtattagtccattttcatgctgctgatgaagacatacctgagactaggtaatttacaaaagaaagaggtttaatttgacttacagttccacatggctggggaagcctcacaattatggtggaagagaaaaacgagcaagtcatatcttacatgggtggtggcaggcaaaaaagagagcttgtgcagggagactccgatttttaaagtcgtcagatctcatgagacccatacactatcatgagaaaagaatgggaaagacttgatcccatgaataatcatttcccacatggtcctcccacaacacatgggaaatatgggagctacaagatgagatttgggcggggacacaaagccaaaccatatttctcatcatgttgcttataacattaatgttgcttaaaacattataccaaattaacagtaaacaattacatttgaaagcaaatagttttgaaagtgtaacattgtcttgcattctaaaacctatctatttaaactccttacttcaaatcatgggctattttttgtcgtcctagatgctagataggtgcagtcttgattcttaaacttgtctatcccatgtccaagcataatgatctgcatataccttgtaaaagaacagtctttactttcatctgtttgaaaattgtccaaatgtgctgattttcttagaacaagatatttaagcatcatctacccccgcaaagttgttcaaataaatatggaaaccatgtatgctggagttgacaaagttctgataaaataagaaaaaagtcaaaataatgaagatgtatcaatatgaattgtatcccctcagatgtattatctttctgcagtgtacacctggacaatggtatgcacctctcctgaaaagagtacagaaaataaaagccctaatcctcactctctttggccctaactggatggacttgtgttgtttgcctaaatcaatcactattactggaacttgaattattctgatggcccttgcctcactctcaggccctggagttaaagtcaatttccatagaagctagaagtggagaaatgtgtgttttaattttattttaagaagtgggtatgaatattagcctgcagatatcaaatatcccttacatgtttgattataaaaataagtagaactgtaaaaaggaatccttttttttcaacattaatccaagaaacaattttcatgccattattctgcctaaaggtaaatatctaagtatacccttgaataggattaagatggctcccatcgttcttgtttatttggctaggctttaggattttgttcagttagtgtttggttgttgtttttcctatggtagtctatgaaaaatctttaggaggaaactaccctttgtattgaacacctggtccaattaggtagcgatagttgacctgtgaatgcataggtaagtgtactttttcaaaaattaaattcgtattggaacacctgttcctgtccatagagttaattgtatgttcagaactgagctttatttggagacttattcataaagggaattaatatctgccactttgctacagagttacagcaaagtcatgccaccaacacataatcattcctgtcacttcctcagttccctacacacagattctcctgctattaatgttccacagattgttgtcaaatatacatcattagataagataaaaatgattgacaaatttttcttttgatgggattgctttttgacaaagtatcactatatagtacacatatttgtgtgtctacacatacgcaatatcatgatttgtgatggctactagtcaatgaataagtcgccttttcactgatactagtgctttatttgtaagtgcatttagcaagtgcttttatatatgaaatcttaaacattctttttacatgtataacctgtggtgagagatgctcagcccagcttccccatcttaatgaaacaggaggagcttcaggacgaaaaagatcataaattatgtttaaaggaattttcaggtccatagtttgagaaagttagctaaagattgacttaccatagttattcttcggtcataagatatttatacacatattgatatattcttataaatattatatataatattaatatttatcactatataacattgaataagagaaaaagaaaatatattaagaaaatcatcaactagacacaaaataaagactttcttctctgttaaagagaacttcaataagtaaaggctcatggaatattctcctgtggaaatcatgaagaaacagaggccccaaccatttttctaagaaaggttagctcttctcttcctggaagagagaatgccaattcacatgcccttttccagtcccactgagcaattagattttatgctttctgactggatatggacaaaagaggaaagttatagaattttccaattatatcaattccacagaaaacttgtccgagacatgcttagttaccaagtacatgcttgattctgtcatgttcagttgttggtgtggaaggacatcatgtcctctcagcttgctttgggaatggccgttctacctccattaagttgtgcatggaaagtgttaatggctttgctggggcgcggaaatagttttggaattgagctaatggtgtatttccccaccttcacaccctaaaaattctcctaaagatacattactcggttcactttattcctcctatgccatatgtgcctagctttaaaaatcaaaaatgtcactaaagttccttatatagttctttatatagacttttgactatcctagaatctgacaaatcaaatcattttaatgaagcacagcaaacatctcatgttgaaacagctgtaagcacactatgcaaattgtgtttactagtagcttatgctccagagaaataatctttatatgactgctttattatttacagtagttttgaaatttaatttttgtcaacattgacagatgccttccatgttaatacttgggctgctatatatggaaaaggctaaacatatgcagagatttcatgtttgtgaactgataatgtggttgacaaatgggtttaacaatatccagtcatttctgggcagtcgatgaaattcacctgaggtctgtgaagaggaaggtcagaggaatatgaatgaagaaagaagaaagcagtggctctggagggccctgcatataatgaaagcatgacagagggtgattaattatatttcagagccagataattcccagagaatatgtgtgcatgataaaaagtttctaacctttccagttgtaattaaatgagggattcactggcctaagctgagtaaaggctgttttgttccataactgtacgaatgcacataatgaaatagtttatttcaaatgtgcattttttactgcctgagttgtgaagttgacaaaactggataatacccagggggtgaggaggaggttcagtccactggggaggactccctcccttagaaatgaactggttaaataaatttagaatggcttggaaaatttacctgtcctaaaatatctgaggatataccctcaggtaaaaaaaggaaatagaagtaattcttaaccaatacagtttcatgtagctttagatttaaatcttctgcagaataatgtgtttataatgttgttcgggcttttcataatgttctgccttttaggtgctaacttgcagtggtccgggctttttctctcttttttcttggcatctcctttcagacaaaggaaagtaatgggtccagaaaacataataaaaaccttttagtttttatgagctggtttgagtgaattctgaattcattagattccaatttttataacaaatatttattgaccactttgtacatgcctgatgctatactaggtaccaggggattcatgccagacatacaacagtgtctgccacatagtaggtctcaatgaataggtgttgaatgagttggtgaagttgaactgtgtgttaatatttgaattcagtggatttggttacttcttggtctacttttctaatatatgaagaaaaagtagagacagcataatgaataaatatttctaaagtgttttggttaatgacaaaaatagcccaatgcctccattatttctgactctatttttttcaatgcaatgaattgcattcattcatttttttgatagcagtatatgagtgactcagaagcaacttaatatttagaatagctggtacaggataagacaaaaagtaagtcaaactaaatacatattaattgaagggtcaataatttggcaatgagttgtggaagggaatggtaattgagtattaggaaaaagagttccaatgcgtcatttaaaagattgttgttttctggatataatgatggatattatgtgtttataggtcctgcctttccgaagattttacagagacccctttcttcaagtgaaaggttatcaactgttggtagtatgctgcattaacagacaactcctatctcagtcacttgccacaaccaagttgccacaaccatcttacttaggccatatgtcagctgtagcttttctccatgttgccttccttcctaaatctaaggctaaagaaccaactttcatatagaacattgccagccactgcaacagaaggtaaagagacctggtgagctatgggctggctcttaaaatgcctataaggaagtgacacacaacacttccacccacatcccattggtcaaagaaagtgaaatcattgaaaactccctgcaggctaaagtgtgctctgttttgcctcctgtcaggtcccctgtacctatcatggtccctggaatatgccagatgcttaataattattgattacaggaccagctacatcattcacaggcccagtgctaaatgaaaatgggatgactttattcaaaaagtaggggggaaagtacaattaaagttactcaaattaaaacttcattctttcttctgtagtctctctctcttctggatctgtcgaggtggtttttatatttgctgtttttatttattatttaatgttgtacttgtccaggttttagagacacttgctgatgagtacagatgtgaacaagtgcctgggagcctgtaaattatccttcccacagccttgaaatccaacgctttgcaatgtgtttggtaccaaacacatcagaatcaggggtggccaagtcgtctgccaaactcactgtggtgctgccagctggggacagggcagctgtctattaaaattctataattttaatagaattataatgttctgttagttttatagtacatgtgttgccaaccagtttgtcagtaagatagaaatttacatacatgtacagacattcacacactgagactgatttagctctctggtgatgaaaccaccaataccaaggcaaattgtgcccttctaatggtgacacacctcggctcaagggatgggatgcaccatatgcttctccctctcctggctatcaaggatggcctctttgatgattgagttttatggaaaatatttgaatatccttgaagtcattatatgcagaaattggaaggccctaaatctaaaggagggtaatatgttagacagacatttattaatagaatcatagatccttcaggtataagggatctttaaagtcgccaagcttgaatgtctttctgctgaggaatggaaacccacagaaatgacaaagcttaggttgcactgcagtgcattcctacagtcttgaccagaatccagctctcctgaccgtccatcaaatcttaaattgttttgatttcttgttatgtttttcttcttctttgagtgtttaaattactttgtttccagtctttattacaagtgatagaagaggataaatctcttatactgtttgagaaagttaagttacatgaaaacatgaaacctagttctttccttatgattacttaaaagattttaaagtaatctggtctaagtaggcttatttacctgaaaaataattgaatttaaaccctctgaatcatgtcctcttcaataaaaaagcactgtgtaatatacctactaataaaagaaatagatcccaatagttaaattcataactagaaacagaattcataacactaataaacatccattttttttaaaattaccttaatgcagataactcagaagtcagcattttatttagaaatgattctttctctttctcctctgctgtcctcagcaaatatattcctttcacaatgtacttgaggtatcttgggtcctatttggcatattaagactataatttggttcaccttaaggacataaaagagatagttataaaaatatttaatcccacaaagagatttgatccttggatattacttctacactagtagaatacagttcagtgtgtgtgatgtttaaagctaaaatttgaattacttcaaacaaaatagagaacagtcacaaccaaggataatgtgagtgagaaatacaaatctctagaacagcgattctcaaccaggggctattttgcccccttccttcatcattcccccaccccagggacatttgacaatagcagagacatggttgtcatgactgatgcttggttgggggtggcagggaagaggcttactggcatctagtgggtagaagccagggatgcatcctacattacacagagcaatcctcatccccagcgaataattattgagtccaaaatatcaatactgcaaagttgagaaaccctgcccgaatggcttattgctcaagttttgtccaatgttgtcacatggatacgcattgctgttgtttgccattgttaccacttaggactttgactaagttaaattcattcttggctttgtcctttaggtaaaatcactttttcatgtccccatcccaaaatgaattcatcatgctcaaaatggattgagaaataaatgtttttctttaaagtttaaaatacatgttttcatattagaagcattaaatcctttactccagtttagtattccaaagatggggaaaactaagccatggtttgaatctactttatcatactgagctatttaaattcttcattatcatagaaataattagttattttcatagtaacactagaatgcttgatagctttgataaagcaagtgatgagaatacgactaaaacagtgtttctcctaaaatgataattttacctgaatattttatgtgcagtttgagtaaatatacagtatgtttacatatatatggatatatataatatttacatttaaccttattcaccatttgaggtgagggtagaatatactacttatcaaaccccttttcttttcccggtaaaatccaagtcgattgagagatggtgtatgttttaaaaatgaagattaaaataacattttggctttcttactggtaaagcagtttgagaacaaggctttggtttgtggccacaacctggcttccttgtatcttcccctccaagttgaatggatgcaggggtgtgttctgagtcttcatgctttcagatatactcatcatcattgccctgctctgctctgggcaaggagaggctgcccactgcagactgtactttccaggctcttgtgccagctggatctagccaatgggcttcactgatgggagacgggaaggtactgggaaaggagactcaggggtgtttttccctctctgtcatgttatctgcagcaagcctatctcctccttggttcccgatcctggcagaaaggcctgtcatgatcccaccttctactgttggactctggtacttagtcccagtaaacttacctgcctgggctctccctgtgacccagggccagaggtggctccctgttactgctaatacccatctcttctttggcttcaaagctcttctgtcacctctgtagccagtttcctgatgaaaaccatgttccaaagattcttcttattctcatctcaaactctagattgtgaaacaaggcaggaatttgagaaagcatgcaccctgagaataggctgcaccccagagggagccaaagcagtgctcctgcttacctccttctcccctggtctgcagtcagatagactccctcttcccaatgggacaaagagagaaggtgctaaggaggcgctgggcatggtctagccctaatatctcctccagcagaacagagtagacgtttccacttttcatatacattgggggccacacagactatattacagaatgggcttcaaggctggactgtcagggttgaaatcgctgatctacctcttgccaactgtgttatgtcaagtcaattactctgtctttacttgagtatctttttctctcgaataggggataaatatggcctgcttcctgggattattatgaggtggatgtagtctaatatacaaaagcaatgagagcattgcctggcacatgggaaaccctctgtaacattagctgctattattattacccctcttggtcatgcccataaaatggggataatcatagcccctacttcaatagcttagttgtaagatttaataagcctgtgtgccatagtaaaggctcaataaattagctgttagtatggccatctcctctggggtgtctttaattaatatttcctttgatgttggagagaaagaaagagggaagttaataaataaatgaaattgtaaatatgtaagaaccaagtactcaagacctttctttttcagctttggcttttctaagagtcatttggtgaaaatggcatataataataaaacaagtctgaaatttaaaatgctagggcttttcaggaagctgcatgctgtgtgctgcgtgcttgctaagtatttggctaacaggaagccatcattgatctcccattctcttttcctgaccatgtccttctctccctaccttcatccatccccatcacctcctcccaccttgctttctaagttttattagctctgtcagcccacttcagtctccatctggactttgaagcaatgaaaaccacaggaggacaatagtctgccattttaaaggaaacagccaactgaaatctccaaggtttcctgaaaaggcccaaaatatgaataatcactttcttctctcttccattaatatcattcataaaagatatatttccaccttaaaagaagttcccatgcatttcagcgctatccattcccaaagacagagtttttttcccacagctgcatgtacactaaaattgtgccaaaaccttactgtgcaatttataaatacaaaagaattttacatacttaaattttaaaccaaactaggcctaatggcagaggaggctaatttcctaatttcctgggcctggggccataagctaaaattacatatacaagtacaaattttctctgatcttatattatagatatctttaaagaaagcatacatattttgcttcaagctccataattattttgacataaaaatagtattttaacatactcattaaattatttaaagctcaatccttaagtaaaattaatgcttctataagatttgctgggtttgtgcccttgacgttttattcctctcaaaatcatctatacccttaggaagacacatacttcactcaaggaagccggagagtcaagtatgttacttaattctcacaatcctaagacgtcattgcagttgtatccactttattaggagacccagttttggagaagttacatgtcttgcccaaccaagtttagacacgtgttaaaagtctttctctgtggccaggcacagtggctcatatctgtaattccagcactttgggaggccaaggagggagaattgcctgagcccaggagttggctgctataaggtcccttaaagatggtaatagtcaggggccgggcgctcatgcctgtaatcccagcattttgggaggccgaggcaggtggattacttgagctcaggacttcaagaccagcctggccaacatggtgaaaccccatttctactaaaaatacaaaaattagctgggcatggtggtgcatgcctgtaatcccagctactcaggaggctgagacagaagaatctcttgaaccttggaggcagaggttgcagtgagcgaagatcacaccactgcactccagcctgggggacagagcaagactctgtctcaaaaaagaaaaagtatttctctgagtaccaggacactcccagtacagcacacaatatccctacccccaggaaaatcaggaccagttgtggtcaataatcataatcacaattgctgaaaagcggtgccatggcttatcttaaaagatgttttgaaaaataaatcttacataaaatgctaatgtgattttgccatatatcatcttacctcaaacactggctttggtatgaccagggctgtctgccctagacccaggcgaactaaacatattccagggagaacactacctcctccagctgaaatgaatcaggatttatgcagccacctgtacaatacattagctgccacctgcagacctacccagctgtaaacaattcactgaaatgaatagattcacgtggccagaactagagaacaggttgaggagtcaggaaagaggagccaacacaaatgtaaaggaaagctgaaggggaattagaaaccaaaccaaaccaaataaaacattgagtttttcgaggaaaggaagcaacagcatctgagttaactacaggtcagtgattgacaattctctgcccaaaaggttttgaacggactgtcctcgtatgtgtaactctgtaatttcagccttcaaaattatgatttttcaaggctaaaatgtgcatggtagttttaagctgaaaggggaggaggaagaatagccaacagtcagatagtgaaccaaatgatacaaatattgtatattcctttaacctgtgagattcattagaattcatttcttgaaaaataattctctgaagcagcatgacatgaggcagtgttaccaaatgctagcaatggacagatttactatgaaacatatggaactttagccttggagtcctcacttgtacacgagttttatgttgtgttccacgttgggagggcaagccagatagcaatcaggaataatctgtctatgtgtctctggtaaagtgcctgaggaaataccagaagaagggcacctatgtctccaagactccaggaattgttgcatttctttcttcattctccgtaaataccaactttcccactttattttgtatttttcttaaagagcctccaccatctccaaattgtagtatatgctttcgattttccaaagcccagatttcttcctggcagtgctgggccatgacaaagcttttgccagaccaaaatgaattaaggaaaataaggataatatagactttttttcataaagctaaattaatattcactacagtttgtggattgtgtttgtttttgatatttttctatgccttgttgataaatatagccttgttgataaatatagccttgttgataaatatactttcttttaaaaaccatggccatagatgttagatgctaattttaaatgtttatatatacacatcttctcataatacaaaatatgtttgaaaattctatgtcaggacagccaaaaagccccgaagcatactaggaacacacttgtagtcaataaatgttgaatttcttgcttgtaacagagagggagggagcacaccttggaagtgcaaggagtcacagaaggtgtgtggggaaggatttgttgtaggatttggcttgtgacataatttggagaggtttcatggttttgccctgaattgaatgctcacaagtatttggttggtgcaaaagtaattgcatttgttgccattacgaaacacaaaggtcacataattagtatttgggaggctaagaattaaacctaaatcatgtgtcctccccccattaaaatggcaaaactgcaattacttttgcaccaacttgtagaaataattctagattggatatcttatttttataagtaggtaggacaaacgaagtggagctaaagcagtaattagcaaagaaataacggtcactttttaggcaggaaagggatgatttgttctgttttgtagtttggctcatgtctgtgttatggtctatgctcagacgtggttagaaagttgtctcattttgccagtcttcatcacagtcacagagtggccttgtctaatgtgggtgggtattctatgaaattgtttgtattcagcagaagggcatcatggtctactgccagatctgctccacactgacaccagtcaagagtgtgtctgtctctctctcttcaatttattcacaaaaatcacagaagtttggaaatcattgcaatagaagaagtagtctgaactagagtgcctgtttgtcccttactagttgtgtgaccctagaagaaatatttaacagcaccaaggcatcagtgtcaccatttgtagaagattaagctgaacacatatctttccctgtagagcgacgtggttgggagcccgagttaagagccacatcatctgggtttaattcttagccccccaaatactaattatgtgacctttgtgctagttattcaatctctttctcatctgtaaactaagggtgaatagtatctacatttcagagtgttgtgatgattgaattaggcaacatatgtggagattttagagtagagcctggcatgagataaatgctcagtgcatgtttgtatctactatcatgatagtgattatgcttatcactctattaattttgcaactattatagtctatgttctggctatgttacataggcatatcaaataacttctttttacttaggtctcattttctataaaatcaagagtaaacttaggaacaaactagaaaattcccctctaggagctgaaatgactgtgggctttgaggtaaatcagttaagattttaagacccatagttgtgttaatcataatagctggcacgtattaaattcttcataagcttattcagttcccataactctgtaagaatcccagaggctcttctaagccccctttttaagtgagaaagctaggatttgagagaggttaaataatctgcccaatgacgtgtatcttgctagtgataaatctgagactggaacccagatcccaaattcacaatcactgctttgtgattgggaagctgttacacaagggactcattacagggcagcaggtgtaaacactttttgatcttagctatttataaataaacttgaaatagaatacattagaatgtctgagaattcaaacaaatggcaatttaaaggaaatattaggacttcttggaattcactgtgctcctaagtcccaaatgttgtttccctaaagctacgtattttcttatttttacttgacaaacaaggaattaacattttcagactgatagaaaatgctggatttcctttttactgatactattattgaacaaaaccaacttttgacatgttccttgtgtcacatatttgaaactcaaatgtgtcttcagttgttttaaatgactgtttactgcagcctctggtttgtgtcattgacaattatctttggaaattaagcctggaaagggaggaactgtgacagaataagcaccattgggaaattgctgggttcactggtcatatctgtgcctcattggtatttcccatttaagatatcatatgttcacatcagtcttggaacatgttgacctgagagtttgcttgcaattcaccccttctgctgtcctgcaaaatcctgcattgtccatgctgtctgttagccattgtgttatcagaatctatgtggccatttcattatcagaatttgatatttgaaagaatacatacatttttcaccataaaataaaaagaattatcatggcagaaggaaagaaaatcagaatttgaaaagcccttattatcaggtagacacaatagcacacttatctctcaatattatctcatttcagcctcatggctctgagaaataagaaatattatctcctttgaaaagataaataaataggggctgagagatgttatgtgacaaacccaaaaccacaaaacagagtttggacatctttaaatagagagttccaaattctagattatagattagattgctgaaatggtttggctgtgtccccacccaaatctcattttgaattgtagctcccgtaattccaagttgttatgggagggacccagtgggaagtaattaaatcatgggggtggttctttcctgtgctattctagtgatagtgaataagtcttacaagatatgatgttttataaggggagttcccctgcacaaactctcatgcctgccaccatgtaagacatgtcttgcttccccttcaccttccatcatgattgtgaggcctccccagccatgtggaactgtgagttcattaaacctctttcctttataaattgtcagtctcaggtatgtctttattagcatcatgagagcagaatattgcaaaatttatctctttctcagatgtatttggatattaaccgggagactatttcagaaatttgaggcctatcatttacagttctagcagagttttgtaaaaatgtatttgtaagaaatacatttttacaaaaacttgaaagtaaaatggttgtataactgaggggatacaacatgagtgaagtatgggctttgatgttagaccaatctgggttcaagtactagatcaccacttgctagcagcatgaaactggtcaaaatatgaaacatctctaagcttcaattcttttatcagtaaaattgagctaacaatattaacttcttaggcttgctgagaagattagatgggtcaattcatataaatccttggctcagtgctgggcacaaagtgagtactcaacaaagggcattagttggggtattactgcccagtgcacagttcagtatcatttattcataatcaattaacatgcataaaaatctccaacatctcatggatgctgagtttttattaatgaaggcttttcaaatggattatatcatttaaagcatgacatagagctgccttacttcactattagtctccataatgaaaaagatatggacccaggtggtctacaaaccagacactctccaaacccttgagttcttactgtagcattttatggtatggagaaaattttaatggaggcatctgggtattgagactactaattgattacatgcgtgttaacttttttttaatatggtaccttcaagggcatatctgttgttcagcctggttaacgtcggcctgtgaatctgttggtataaaaacatgttacattttgacactggctaggatctaggatctcatttttctcattttgcaaaactggaaagccagcctcatattttatattttctacatgcctggttttcatgaatcagctggttggtgatcaactgggattttgtgctgctctcacaaatacattccccagtgcctggcttgggctgtgtggagtgttgaaattaccaatttcataaaattgcttttgatgttgggtaagatgctatttttattgaacacagcaattgccgtcccagtttcagaaggacagtctcttcttcttgatgatcctatttagtttcagatttgtgtttggggaaagtagttattacacagttttgaagccccttcagctaaaattgctggggaaaatgtctgctgggccgggaagctagtctaagcatttcagctgttttctgagagatgttaacaaacatttcaaccttggtggattatcacaatttgcctacagcattttccagggatttgcataaactagcaggctaacgtgaggcatagatgtgttacctattcatttttattatgcagtttattttggaattctctttgcctgagtatcaactcacaagtggcacttatttctgtatactctttatttttttattcattttaaaaaataaactctttatatataataaatatgtatatggccttgcatctctgaagagcagaaacagatgaacttgaactagaaattagagcttaatggtaggaaacaatgatatggaagctaagaagaaaggtgactagtggtaaaccaagaggagtgatttaaaaaatgttatgaaataaaaatcaaataggaaggcaaaaacaaaatggcatcatggttccaagccatgtacaaaattgaaaaaaaagtaaccccatgatgttactaagcactgtgattctatctgtgcccttatctctcccaagcctccttagagaagtaaacagtcttgcttgtggccacttttttgtttttttttttttgggacagagtctcactccgtcacccaacctccgcctcccgggttcaagcaattcttttgcctcagcctcctgagtagctgggattacaggtgtgcacaaccatgcctggctgcctttttttttttttttttttttttgtatttttagtagagacggggtttcaccacgttagtcaggctggcctcgaactactgacctcgtgatccacctgccttggcctcccaaagtgctgggattacagatgtgagccacagcgcccagccacttgtgaccactcttaatgttaaatgtatcattttggtgcctatgtttccaaagactgcccctcaaggataatctgtgccagcatatctattcagttccagttctgtcatgggataagtctttactcagtgtggtgatggttaatgacatgttagagattggcttcgaagttcagaggccacagttcttgactatcagatcctttttgctctcaaacaagactcttgtgaatttgttgttttgctttgttttaatgcccacagtctcatatgttgaccattggctttctacaagctcaaggaacacatcttcaatactagctgctggttaaccttacactttggaagagttttacatgtataaagttggaaacaggagagacagaggcagcctgtggctgtgtatgaataatctctgacctatcatgtttatgaagaaattctgtgctgagagatagagaaatgggagggttttcataccttattaatttagaattatataaaaattaattcacctggttctgggttaaattttgcattagtcttggttttttaagttaaaaatgaccaaaccccaagtcaagctggcaaaataaatacataagtacatgcatacacattggatacacacataaactgaagtactcttgtgtgtccaattgcagggatagctgggtccaggggctcagagaatgttaatagatatgtgactgtgtatcagtaccacttatatatgtgtgttggcctaattcttacagaaactggctttgtccatgtatcatgggcaaatggtcaaaagaagctacaggttacgtcgtcatagttctagatgcaaagaagtctttctcttccaggcttcttctaagaaacctcacttcagattctggttcagtttgggttgcatgccctttcctgaaaccatcaatctggccatgtgattgaggcctctattaaccaagctgatccaggtgcttattactgcaactggagagtaaggctggcttcatcaaaccacataaatggattacttactgtgtggattatttcaataacaaagtcacacagggggatctggagagctataccaggtccccttcatatgtttttactttgtcttaagtcttattttgctttgaaatgcacataatagaaatgacaatttattgagttcttgctgtgctttatgtgtgttatcacacttaatccccaaaacaaccctgggatgcaaggtatgttatcaatattcacaatttacaagggaagaaatcaaagcttagagaaattaagttgccttgggtcacataactagtaggtggtagaactgggattggaatcagatataataaactactaagcttcatgactgtgttttattcatttatttggtttgtataattttggaagtttttagctttgagatatttacctgaaagactgccttaatggtcttagtctatctggctgtgacattttctactctcaataaatatttgtattgcccttactagatttaaataccttgaagacagggaatttcatatgtgtttttttttcacagtttaaaaatagttccatacctaaaagaattgaaaataggtgttcaaacaaaaatttttacagaatgttcacagcagcacaattcacaatagctaaaaggtgaaacaaaaaacaacaaatgtccatcagctgatgaagtataaccaaaatgtggtatatccattcaatgaaatattattcaatcttaaaaatattaagtactagtacatgctataacatggaagaacctaaaattcatgatgctaactgaaagaagctaaacacaaaggtcacatattgtatgattctatttatattaaatatcttgaatgagcaaatctattgaagcaggaagtaaataaatggttgctagggttatggggagacaggaatggagactgacttcttgaagggtacaagttctccttttggcctgaagaaaatgttctcaaactagatagtggtgatggttttgcatcactgtgaatgtactaaatgccactaaatttcattttatatgatgaattttatattgtatagttcaggcatatagtagatacttgaaaaatatttaataaatgaatgaatgctagtaagataatagactttttaaaaaataaataagttggttactaggactctaccattacaaagatgtttattgtaaagatttgaagccaaaatcaggcaccttttaggaggttattacaaaatttgtgtgacttgcatagaatcacaaaaagactctgaatagctaaagcaatcttgagcaagaacaacagatatcacacttcctgattgcaaattatattacagagctacaggtgtaaaacagatacacagaccaatggaacagaacagaaaggacagaagtaaacccattcatatatggtaaattaattgtcaataaaggcaccaagaatgaacaatgggtaaaggatagtcttttcttttctttttttttttttttttttttttttgagacggagtctcgctctttcgcccaggctggagtgcagtggcgcgatctcagctcactgcaagctctgcctcccgggttcacgccattctcctgcctcagcctcccgagtagctgggactacaggtgcccgccaccgcaccctgccaattttttgtgttgttagtagagatggggtttcaccgtgttaacccggatggtctcgatctcctgacctcgtgatccgcccgcctcggcctcccaaagtgctgagattacaggtgtgagccaccgcgcccggccaaggatagtcttttcaataaatggtgttaggaagctgcatatctgtatacaaaaagaaaacagaaaaaaaaaagaaattggatccatacatagaaatcaattccaaatggattaaagatctaaatgtaacatctgaaaccataaaactcctaggagaaaatatagtagaaaatcttcacggcatttgttttgacaataattttttggccaaaagcacaggcaaaaaaataaaaagcaaaaataaataattagattacatcaaactaaaaagttattgcacagcaaagaaaacagtcaacaaaatgaaaggcaacctgaagaatgagagaaaatatttgcaaaccatgtattggacaaggagttaatattcaaaatataagaaactcatgcaactcaacagcaaaaacaaaattttttaaataaaaattgggcaaaggacctgaatagacattgtcctaaagaagacatgcatattaaatgaaggagaccaacaggtatgtggaaaggtactcaacatcactcatcatggatataaatcaaaatcactgtgatatcacctcacacctcttagaatggctgttatcaaaaagtcaaaagataataagtgttgatgagaatatggagaaactcttgaacactgtaggtgggaatgtaaattggtagagccattatggaaaacagtggaagttcctcaagaaattaaaaatagaacacacagccaataaccatatgaaaatgtgttcaacattgctaatcatttagagaaatgtaaatcaaaaccacaattaaataacatttcacaccaatcaaaatagctattcctaaaaagtcaaaaaataacagatgctggtgaggttgcagagaaaagagaacacctatacactgctggtagaaatataaattagtttagccactgtggaaagcagtttgacaatttctgaaagaacttaaaacagaattatcgttagactcagaaatcctattcttgggtatatacttaaaggaatataaatcattctgtcataaaagcacatacatgtgtatgtttttcacatcaccattaataggaaaatcatggaatcaacctaaatgaccatcagtaaacttgataaagaaaatgcaaatatacaccatggaatactactgcacgtagtgagatgatatcctttgcagcaatgtggatgaaggtagagacctttatcttaagcaaactaacacagaaacagaaaaccaaatattacatgttctcataagtaggagctaaacacagtacatatgaacacaagggaacatcagacaaagggacctacttgagtgtagagggtgggtggagggtgatcaaaaaactattgggtactatgcttactacctgggtgatgaaataatctgtacaccaaacccctgcgacacaaaatctacctatataaaaaacctgcacatgtacccctgaacctaaaataacagttttttaaaaaatagaactaacatgtaatctaacaatcccatttgtggttgtataaccaaaggaaacgaaatcagtgagtgaaagagagatctgcactcccatgttcattgcagcattattcacaatagccaagatacagagtcaccacaagtgttcattaatgaatgaatgaagaaatggcatattattcagccttacaaaagaaggaaattctgccatcaattacaacatggatgaacctggaggatgttattataatgaaataagccatccacagcaagacaaatattgtgtgatttcacttacgtgtggaatctaaagaagtcaaactcatagaaacaagtaagactgtggttaccaggatttcaggaggtgggagaaatggggagatcttggtctaagggtacaaaactttcagttataagatgaaaaagttcaggaggcccaatgtgcaacatggaaactatagttaatatactgtatatttgaaatttgccaagagagtaaatggtaagcttatgacacacataaaataatgctatgaggtgatgaacatgctaatcagcttgattgtggtaatgattttactatgcatttatacatagaaaaaatggtatgggtagggccatttatacatgttttcctttcttcattcttcaagataggaacagagaacattcattctattaggcatagttcaaagcagtgctgagatactatatttcttttgttgttgttgttgttgttacatttgtcgatttgtgaaacagcttttgaacatgttgaagaaaatgctaggagtttatgaacagtagggaaagctagatctttcaaatatatctacattggacagttacttaagcaatgtataagtcaggatagactctcagtgtgtctcaatcttaatacaaatcatgtggtgatgttgttaatatgcagcctctgactcactagttctgaggcatgccctaagattctgcatttttaacaatctctgaactgataccagtgctgcttgatcaggtaccacattttgatttttgctgtggtaggaaattcaccctgaaatcccagcgttttgacactcgtgctatatgtctcactcatgttacatgtctgaggcaagtcattgagacacattgatatgggttcctcagggacccatatcaatgaaggatctatcatcttgctgtttgttgtatcttctgagggataggaagagagagggttggaaaacagagccccagcaattaaatacttgactccaaggtgtcacacatcacttatatcacatttcattagccagtagtagtcacgagagcatacctaacttcaagggaataaagaaatgtaattctgtgtatattctgaagcagagcagaaccatagattagtgaaccttagtaacttgtcaaggtgattgtgcatggagttttatcatgtgaccataatggtcattcacaagcttcatgagaaatgtgtttgcattatggcttttgttacatgccttttatttataagagcgtttggtatgatttttctttctcttcataggataagctaataattcttttagactgatagaatttgcagctgaaaggaattatagatgttatcaccaacgcttttatttagtaaatggagagtcagaggcataaaaaatgataagcactttgctttccagggatgagaatatcatgtctattatttagttatttgggcttcaactctgagtctttctatggtaccactgcccatttttccctctgggaaatagcaatgaatgagttatccatacagagatcaacttttccatactcatgattatacacatgatcttacatagaactttatactcctttaagttttaaaatagttggattaaaatgggtttcagatgcttaataactcaaatttccaggccattccaatggtttatggaaacagtgggacaaatttttttttaattggagaggatatcctataaaatataaggcatgtttttatacacatatacgtaatggtatcagacacatataatcatatcccaactttggtaggttgagttcgcttttaagaatttccattaattataaaaattactggataaataatggatgatagcaatagctagaatgaacacccagttgccgctgaattatgtgctcaagtaaaaatgcccttagaaaagaagaaaatctcacgatattactggtgacatagaagatttacttatggaaaactttcctttgttgctttgtcaagttgtcatttgtacaccttctttgtggttcccagatcccagcacactcctttcaacatttgttctatacatctcttccaccttaatatactgagttggaaaagtggcaggttattaagaaagaggcgagccttggagcctggcaaacctgggcttgaagcccagcaccacacttttgccagctgtgtggtgttaggtaaaacacttcctctctctgatcattggctttctaatttgacaataaagaacataatgtctaccttgtctagttgttgtggggattagatgcaatatatgtaaaaggcacctagcagaggggtcctctcattgcatgcattccttaaatgctgactatgattattttaaagccacgggaactgggcttcagtatctgaaaatcttaattctgacatcctttcctcagtgactttgatctctaattttcatgcttttgggatcctcctaactgacttttctgatactacttacctctgatgtgcttttatcatgaaaaagctaggctcaagaattatctatatcttatttttaaagaaaatccagaaatctgaatatctatgtgaaatttcctcttctccaccatcagatctgtgagaaaacacatctttggccaagagccaaagtttgtgactttctattaagcgtagtttaatattccccaaagtataatcttcaaactatctgcttgaaaggtatgaggatgaaaaggaaagttacaattatcattgtaggctattaaatcagaatatctggggtctgggcaggatatgcattttaaacaagctttccaggtgattctatgtcctttaatgtttgattatttatttatttattgagatggagttttgatctgtcaccaggctggagtgctgtggcacgatctcagctcagtgcatcctctgtctcccagattcaagcaattctcctgcctcagcctcccaaatagctgggattacaggcatgcactaccatgcctagctaattttcttatttttagaagagatggggtttcaccatcttgtccaggctggtctcaaactcctgacctcggtaatccgcccaccttggcctcccaaagtgctgggattacaggcgtgagccaccgtgcccggcctaatgtttgacaatttagattagttggagtattacccccttttccaggcttattgagatatagttggtgtattagtctgttctcacacttctttatagaaagaactacctgaggctggataatgtatttttaaaaagtggtttaattggctcacggttccacacactatacaggaaacatggctggggtgccctccgaaaacttacaatcatggcgaaggcagacgggaagcagcaagtcctatgtggctggagcaggaggaagagagagaatggggcagggggagcgggggtggtgccacacatttaaacaatcatatctcatgagacctcacttactgtcacgagtagaacaagggggaaatcctcccccatgatccaatcacctcccaccaggccctacctccaacactggggattacaactggacatgagatttgggcaaggacacaaatccaaacgatatcaattggtgtacaaaaaagttgctttggtatacaaaactgcacataattgatgcatactatttggtgagtttggacacatgtatatactcatgttatcaccaaaattcaggtaataaacatacccatcacctgcaaaagcttcctgtgtccctgtgttattctgttttttgttttgtgtatatttatggtaagaacacttactagaagatctaccctcttaaatgtttaagtactgcatttcttaaagtaaccttgaaacggtatcaggaagacacagggatggggcacattgtggcttctgagggaaaccctaggtatgtgaagtgaggtacacatccacctaaacttcacattcttttccatttgccgatcttctctcttccagctgaaaaaagagcagtgtggcatgcctgagacattgagtccccaaccaatttcattaattcactgaagaccacatggttgaattttctgatcacttagtgggtttctgtcaaattagattagctggtgttcaagtgcaaagcttaaggttctttgggttggagttcgtttaaagatgtgggtatttgtttttgcagtacaaggttgtgttgaaaactcttctccctgatgagctctggactacctgctatggatctttcatgcctgttgttaacaacacttggatgaggccatgctttaatttttacttatgtaatggaactcatccatcacattttacagagcctttttgatacggtcagtgcttatcggtgttcaaaaaataaatccctgttccaaacctgtatttaattccaaagcaattgcctttggctatgttctacagtcagtactgaatacgttgccttgtaggtggttttgttttattagtggtttctgagtttaaacaaaaatatgctttgtttgtcttctagatttcagttagtattcatgcctctgttaacagtgaatgttcgataaatgctatctaataaaaataacacagatatcattttttgagcttttattatgtgccatattctgtgttgaaccctttataatgaagcattttgtgttaaggattctcaattcatccttaccagaaacttgtgaatattgttgtcctctttttatagatggcaaagcaggctagaggggtttgaaattattgagccaggattcaaaactttgctttcttattccaaacctgtatacaaggttgatttacataaactatcatgaagaaagtttttaataatttccactttagcctaacatctggtaactgtattaatcagttattgctaccatactgctgtataacaagttaaactaaaactcactgccttgagacatttgttgtttgcttatgggttggtgagttgtctggagcttgatctaagcaaggcttggattcgtgctgtagattggattcaagtacaggccaagtttttccttctgaggctcaggctaaagggcagcatcttcctagggcatagtcgtctcatggtcaataacaagaagacaagagaaacatgtaatacctctcaagaatatggactagaacaggcatactgtcaatttcacctacattaaattagctaaagcaagtcgcatggccaaaaccaatatcagtgtgatgagaagtgtggaaattagtgtggatgctgagagcagggtaggtatgtaaagaaccgcagcagtgcttacatccaccatagtcacccttccttttcttctcatgctcactgaaatgtcattggtttctgagtgtggcattaaaagaactgaatttttctacaaattaaaacaagattttacttttatgtctcattaaagttataatttcagaacatttttgctatgttaatcataaagatacagagacttgtatgattagagacatgggctcagtagagattgtgattactgtttataaatgattatggcaatatggatagtaatagccaacccaatttgagagagaaagacaaagttaaggttcatttattttttgaagacattatattaatatatactacatgagaaacagaggcaatctgtgtattgaaaaagtttattaaaagctcttttgatgctttatttggtagagctgtgacttacaatccttttgttctagatagaactacatttttgcagtgtgtacaactctacttaaacattgccagtgtttttgaatatgctgttgccacttttgtccttaatgtagatttttgaggaaagaaaacatcactaagatattgcaatcttttttccccacctctttgcaaactatgactaggccagcctctaatcagtggtatgctggtaaaccatctctaaaagagaggggtggaggggctatgatttgtactgttcaccgatttgtaaggtgtaaatattcccaccatggctgctttggatttgccaatggcttaacaatcagctcacaaaatgcagctatgagacagctcccacaaccatcttctgatacgaatactatttgttccaccaaggagtttcctatcctttttattttcttctaattattttttcatactgcctcagtttgttctcatacaccatcaaaacaataaattaagcttaagtgattctcaaaaactagtatgaaaatatggtgctttaaactttgaaaacaagccactgtgtttttgacatacatgcaaattgagtattctactgtagaagacagcacagaatcctaaaagatcacagcctatcatttgttacctgttcctcaaggtataagaaaagaaactaaggttctctttgaatttaaatagccaaggtttcagtggaccaaaaggcatctccttccctgccttctgattccatctgaaataagctacatgaaatccatataactaaactttgtggttgcattggagaatgtacttaacaggatcatatgtcaatatgtcatgtgaatggaatgactttaaatgtagaaggcatttgaatggtagaaatagtctctcctttgcgaagtattatgcgaaggaatgagactgggtaaaatttcctttaaatagactcaccatcgcactctactccttagcaactgacctctccccctggagttgagtgatgggcacatattctgtgtattttcctctcccatttttttttctatggatatttccttgaacaggaaagctcaatcatttctagcctaggcacattagattcttggagggatttccaggagtaagtacacatccatccttttctctaattaattcaagtactgagcattgatagggtcacatgccctgtcttacatgttgggatggatacaaaactaaatttgattttttttaagttacaatttaatgaggaagacagaaatctgacctgtattcacatttccttaatctcaggcaaaattgaagggcaaattgagatctgtgctatgaattcagataaaagaaaacagacttacagtggagacgttgagagtaagggaagccttcctggaagagatagcattaaatcgtgggtaagatgttgatgtctaaaagttaggaaagagtgagctagttttccagaataagagaataaccacccaatgggttcaccttgcccactacctagacagagctgatgtatcaagacaggagaattgcaatggacagagtaattcacacagaggtggctgtgtgggagaccatagttttattaatactcaaatcagtctctccaagcattccagtattggagtttttaaggataatttggtggttaggggctcaagaagtagggagtactggttggtcgggttggagatggaatcaaagggggtcgaagtgagtttttcttgctgtcttcttttcataggtgggatcgcagaactggttaagccagacagcctgtctgggtggtgtcagctggtgcacccagtgcagggtctgcaaaatatctcaaacactgatcttaggttttacaatagtgatgttattcccacgagcaatttggggaggttcaaactcttgcagctagaggctgcatggctcctaaaccataatttctaattttgtagttaatttgttagtcgtacaaaggcagactggtccccaggaaagaagggtgtttttttctggggggaaaagggctattaccaattttgttgcagaattttcagagttcaactataaactactttccttctcaaggttagttcagcctccgcccaggaatgaacaaagacagctccaaggttagcagaaaatggagtttgttaggtctgatctctttcactgtcataatttcctgagttataatttttgcaaagttggtttcaggaggagtcaccgaagtaaaggttagagatagaggaccacagagtataaaccaagagatctcagttattcagtttggctggagcttgatagggaaaattgggagatgtggaatgaaagtttagcctgaaaaggccttgagtaccaaggtggttttggaactagtggcattttgagttggtggttgaatgaaggcacgtttgaagaatgggatcttgctgaagaaactgcatcatcaaatggttaccatcttccccttaaagctagttgagctatgaatgggtggaaggcttccacccttttgaccaattctgaaagctgggtggcctccctagaaatgatcactgactctggcaaaaataagataaagggaataaactcacaaaacaaagatacccctgtcctccaaagcctccataatgtatcagccccatgtgagatccaaaccagtttggaagtaaatgtaagaaagtactagaaaatctaagatttgccatcttgatgcagaacaacaaagtgcttgtccagttggcttttgtttctcttgtctcatcctgcttagaactgatgagcttctggggagtttctttaatcagctccgaaaggctgtgaacttgtttattcccatatcagtgcagcaagatggagtcagttaaatttagcttaaacattaagtaccattcaaatacgtctttctcttaactatacaaatcctgcagaaaataagattttcatgtcttaattgtgatacctaaagtgtcttttattctcagcatgcttgagatagcaaagtaattttcgagctgaatgtgattgtctcagacagtcatgattcaaatatttaatctaaagggaaaattcccagagtgcctctctcgtcatttctcagttctatggagaataaaagcctcaactttatatgatcagatattatttccattattggtattatgctgtaggcaaatatccttcaagaggcaaagtctacatcccttgtgcttagcgagttaggcgtcacaaaggcccaatctggcctttacaatatgagctgctgctaccttgtaatctgtggagaatttaataactataattttactttatacagcacagcctttaagatttaatagtagattcttcacacacacaaagtatatttttctcttgtaaggccttttcttattcaaagatcaaatttcctataggtttagttgctttaacaaagtgcctgtcaggttgcactttgtaggggtgggtgaggatctatagattgattacctggggaattggatgaaagcaactttcttagcaacccactggcatcatttcaagttttctcattacccattaagaagcaaatgtcctaggttaattgtcttttctaaattgctggcattttaatgtatcccaaataaataatgttacatctcaagcagtttttctccaagtataagtcttcagaccacccatgtataaatctcctggtgagattaaaaatgcagatttctgaggtacccttaatcttactgagtcagaatttctggggataggaccggtagtttacatttttaaaaagagaataatatgtgattcttatgtacactaaagtttgagacatactggtctctgtgctttgaaatttcactatttaattttattcttacaaatgttatgtatgatagtagtctcttcagacttgtaggtaaagataataaagtacagattggcttaagtatggggttctcaaattccatgctgaggtacccatggatactacagtgatctcacagaggtttgcaggatattttaaaatttctgggaaaatacagtgatacttgagatctgttgggcagctactagttcaaggcagttcaggttcaaactatatctctgttgcacttgttgccacatattttttttatgttgtcctgtttgtgtagccgggtttgtagttcttgctgtgaacaaaagcttgacccatatgaaaatcaatatagaacaagaaaaaagaatgctgctgtccaatctgattctgacatttaagaagtgtgcagcaatattattatcaatttttgagatggagttttgctcctgttgcccaggccagagtgatatgtcatgatctcggctcaccgcaacctctgcctcctgggttcaagcgattcttctgcctcagcctcccgagtagctgggattacaggcatgcgccaccacgcctggttaattttgtatttttagtagagacagggtttctccatgttgatcaggctgatcttgaactcctgatctcaggtgatctgcctgcctgggcctcccaaagtgctgggattacaggcgtgggccacaaaagattttattatatttttataatatttaatatattcacatatgtgacattttataatatctctcaaataatgtatattttttcaaacagatgttaaaacatcagaacataaacatctgttagggtgtttgaactacttaataaatggaaatattaagtgttttgggggcctactgtacacagtgaaaaactactgggacactaaggtaccacatgaccttactaaagtttgggaacctctagtttaagtcatgaatttgtggaagtaaattatgaacccaagtctacatggctctaaatgctatgtatgttgaatgatgcttcttagatcataatctcatcaaggaattccagagtacagacgtgtgtgatgacaggcttgggtgtgaaatgctgttcaggactgcatcattaacataggagttcattattctcattcttctaaagtggtcacattgaactgactatcaagtaacctcgattctagccctgacttttccccctagctttgtgactttgggtaggttacttctctgtgttttagggttttagctgggcttggctacctaacaacagagataaggaagaggatagttataaatatctacacagtctttagctgccaggcattgtgctaagtgctttgtgtcattgtttttattctcaaatatccttgagttattttattaggttcttttattatttctatttaatagataagcaaactgagaaatagagagtgaagctctctaccagccaactaacagctagcacagaatatccaacaccggaaattatgctcttaatcactgactacaaaagttataaataagtttattttagttctttacagtcttcaaaatagctacaatttaggtaacagagtgaggccctatctcaaaaaaaaaaaaaaattcaaggaaatctagtgcctcattcatatttagatctcaggagattggcatcatatggagtgtaacaaaatgtccaccttcacagtctacatcctggaagagatcaccattttgaaccagaccaactgtgaacctctggagataccctacttcctgccaaattcccacagattggtcaccaaagcaggaggtcacaatggactggaatgaaagtgagcaaccagggccagatctaatccttacctcgttcaggcagagaggcctagaagaagaaatcagaatcaaggaccagtgagtggctgctgtgtatttctcatctgtctgtagctatcatccttgcagcccttccttccataacagaatgcaatttccaaagaaaaccaatgaatatagaaatagagctgcccttttacacaggaaaatcctctgactcgaggaaaatagaaaaggggattaacagcactcagggtgtaagaagtcaggggaaaacgtgagaaatcagcaatccgttgatatgaacagtagagtgacatttaagctggccaaggagacccaggagatcatgttcaagcatttctttaaggcagagaaataccatctcattcaagtctttgctattgcctggaaaacaccttacagctagaaataataataataaataaaaaggcctttgcaaaaagtgttgtggagtaatgttggaatttgttttttaaatgaaggttttggaaaaccagaggtatcccattgagaatttataccatattttttgagatggggataggaaagggtggatgaaaagatatactgaggatacttggtaatgagatgcacattctcttttttagagataaagatagaaaagattggccggagagagaagcttgttaacttacaggcctgactctaccagcaaactaacagtctgcttagaatttttccagaaggaatggctggctacttcgcagctcttttttttacactgtttccttgggacctcactagctgcatgtggatcagatttgtctaattgagaagccaaaatatttagaagtactagagggatgggcagcctactcagatggaattaagttttgtgtgtgtgtttgttgttgtttttgtttgtttttgaaacagggttttactttgttacccaggctgtagtgcagtggcatgatcatggctcactgcagcctcaccctcctaagctcaggtgatcctcccacctcagcctctcttgagtagttgggactaccagtgtgcaccaccacacccagctaatttttgtatttttgtagagatagggtttcaccatgttgcccaggctggtctcaaactcctgggctcacgcaatccacccacctcagcctctcaaagtgctgacattacaggcaatcttgtgttaatattcaggagcagatgtgcttatctggcattttccttctctgggccccaaaatcttgaccattgtagtcataaagttctctaccagctcaaacattttaaagcaacagtatttgggagtgttctttaactcatggcctttatggtgacaacagaagcattgattgagaatgactgctaacatttttgaggctctatcatctgacaactgctgtacacagaacttgctgtaggttaactcctttaagtgacaaagcagacttcagaggcttcaagcgacaaagtaatttgcacaagtttaaattttctgtctagagttgttccatattcttcaataatgagatgtactggtgcttcccaacttctttttctgaaacaagacacaagaaacaaaatgttttagtatgctggggtgtattttacaagcaaatagcagaggctagagggctgatagaaacagtatcatgacatataacctaagtgacgcaaatgcccaagatcctaagatctttctatgagggaactagttccatcccttttctcagaaggttcttttgcattagtccagcctgttttctccactgtgatcccacatgtaggatcttgctttcatcttatgtcacctactctgggatgaccaattcttgaatcatggccgttattatacatcattttcatctggaattctcttactgcttatacttttgcagaaagtgtgatttttgctattgagtttctgaatgattttgcttctctttaacatactccgcaaatactagttgtctgctttaccagttcacagggatgccctgaatgatgttacaacacctcttccctctctctcttgctatccgctcccttgctttctcattctggatttaccaagactaggtattctccagggcaaaggcaagagttttaaattctgttattgtttgcaggaaacttcactttcctctcatccaagctggaaatggttctcctgtagtgcagcaccataacactttctgtataacatagttatttcctaatggatttatttatttatttcataatggatcagacagtacatattttaggttccacaggtcatatggtttctgttgcaactgtgcaactctgtcattgcaacatgaaagcagccatgggcagcataaaaatgaatgaccatggttgtgctccaaaagaactttatttacagtaacagatattagactgcatttggcccatagggccactgtgattccagctcagaaatcactagctttgcctttacttataaagagtagaggcaagaggttaccttttaatcatatcatatattctagcaacagtcaactacaatatgccttttggaagggtacatctttatttttatccttctctgcaacttgttcaggataatgtctctgagccatttttctcctattgggtcttttctcctactggattctttatctctctccatttgaaattcctggctgcaagggtttcaggtggggactagtgtggcattactgaaaggcaaccaaaatcagtgagacttagtgctagtcctgatgctgccatttactaactccctgatgttgattcctcagagccttttcataccttatctgtaaagcagacactcctcaaggggttattgaaaaggtaaaagtgccacccacgggagcttttgacttaggcccctacttcttgctagctgtgtcatctagagcaagttacttaactgctctatacctcagtgccattgcctgtaagatgaaatgagaccttgtaaaaattaaataacataatgtatgtaaaaatgctcactgcagagctttgcacacagttagtctatactaaccagtatttgtatttttatgtatcattatactcatttatcactatacttatggactgcttcataaattccaagccagagtacacagtcacatacaatgtctaaccttttcttctaccatcaaatatatttggccacttaaataaaagagcttatttcgtcttactcatatgctttcttgaactagaaatttcggtgatagaaaaccattgcaagctacctgagacctattttcctaattttgttcctgtagatacatttcagatgttagaggagggaacatttaagctgtaagatccaattcaggcatcctgtttctctctgagctattaattaaacttgactcctgaaacgccaataaattgcaaagggcttccaacttgctacagttctgtaatatttcaatcaaagtttctttatgatccttgttttcttcccacgctcctccaccccaagaacatctgaaagcaattttaaaaactcaacatgcaatgtaagaatgaattactgcaatcagtcaaagagatcacattagttcatgaaaagtagcatggttgaaaaactgcactaggaagatcaaggattcatattaaagagggggttggggcaaaagcaaaatgaatggcttttaataattttaaaacatggttgatacaaggtgtagaagctttttgcttctaaaacaaactggttttcttatgctaaaaccttgttacaaagctgatgccaatctcctgcttgtttctttataggagactgatttcttttttcctttctggaaatttctccagaatcattccctatggattcagaaaattctgctattttctaaggacatcataaaatttgagatcaattctcctaccagctctgttatcttgactatctcttttttcaggttttgggggggtttggcttggagcgtttaaatcagcatttaccatcttcaaattcaaagttatctgcacctacttttttcttcgttttcacaagcaaaatgctttctaattgctaaaaaatttgtaccagaaatcacagcacataagtccccatttttctggacatgatattctcttatgaaaaggtgttacggaaataaagatcccttagagactacagcaaagactaataaaggacgataaagtcctacggcacccatatagacaagaggaagagttaacagtcacagatgtttagttcttcagcatgtgtgttttatttgggcatagagtgtttttaaattttcagctggcattttaaaatttcataggaaaaaaagtcaagataagcagcaagttgtacctggaaagagccagatagtaactattttaggctttgaggcttacaggtttctatcacaaacacttaactctgccatcgtggggagaaagcaaccataagcaatatgcaaatgaatgggggtgtggctgtgtttcaataaaactttatttgtaaaagcaagcaggggatcaggtgtggccattaggtcttagattatgaacatctgatctagattatcaccttccctagtggggatgcggaagggagcccagaagatcagcatctctgggtccgtattcaccataatagccttgagccaattaacaacagttcttttttcacacagaagaactttatggtttgccacagtccccactactccctatgaactcccaacccagtttacttcagtcgttagcagtatttatctggcctctgtataatttagactctataactctgatttaagggttgtaaactgaaccgtgcatatgtatagttattgctataagtagcaaatgttatcttaaaaactctggtgggccaaagtgtggataacaagactgcagtaagaaagaaattggtactcagcgcctcaatcggctttgtttgatgaagcactgctttaagaggctgtgcatataatccctgctctagaagacctgagagtttaatgttctgcacaaatccaaagaaaagcaaaatgttgagtatgtgttatatacaatgagagacaaatgctgttcttatttaattatgttatgccagtatcttatacacgctgttcttatttaaatatcttctaataaataacagaacagagtttctcaaaggctggtccttggactttttgcagtagaatcatgagggatgggagggatacatgcttatagttagattagaactacagatacctaggcctaccacagatttcctgaattagccttctaggatctgcatttttaaaaagtcccaaggtatttcttatacactataaaattgcagaattgctcctataaaacaaggacaggtattgtacttcctgtttgtttattggatgtaatttaaattcctttttaacagaaaaacagcaggatacatcttcaggacagagtcaattacatgtacgaacatacattccagacacaattaagcattgatgaagaggttgtttatctgtgtcagaaagagctccatgctgggtctcctaataagtagtcgtgtggccgtggaccagccacttaactggtctggtctctatattctaatctgagggcagaaatgagggcattgctaaaagaccaagacccttgtagctgggaaactgactttgaaattccattaaagaattcctatgctgaagcatatggtactgtcttacttgattagtgagatggaaggacagtattccctcctaacaggtggcttacctgtattccagtagagtggggcttcccacctttggatgctcattggcatcatacagggagctttttaaattcctgatgtccaggccatgctccagatcaactgaatccaaatttctggtgctagaacccaggcatcagtattgttaaaattccttgggtgtttctaatgtgccacccaggtaagaacagcagcactagagcaatggtagccaaagttacttaattaaaagagtaacctgggttgcttgttgaaagtggaaggtctcagtcactgtcctgaacaatccaattcattgagcctaggataggttctggaaatctgtttttgatgagcaaccaagacgattgttggaatcagataaattggggtaaacaccacaccagagaatttcttagtgtattaagcagattcaatgcagtagaggggtttttcttcaacccccataggtttgtagttaaaatggacacctgttacaaaagatagattaacaagagaaaaataaaagtttattaacatgtgtattttatatattcatgggggacactcggagtagctctctaagagtgactttgaattccagcttatatagcatcttcaaaaaggaactatacatttttagagagttgacaagacaaaggaaaagaactttgagtctctaggggtagcaatttaagggagaagacaaataactggaagagaaaagctcttgtaatagacaagcttgttaatgtggattcctctggtatcatctccaggctgatgagggtgtaaagctgtcttcagtggttaactttgttctccccagcagagagggggaagtttacctttgtgtttgcaaagctctgtcttgtttttaggcaagcagagtgaggtcagagagctatcctacatctgtttcatcttaatggtcttcagctcaacagtcctatttgggattcctatttgggattcctatttgggggcagcaagttctattcttccacactggaaagcagtgtggaatgctctattaagagcattaaggaatagagatgtataatcgaaataagaatacacaattgtgggagattccaggaaagtaagggtctgaaggaggtgggagatctgagaaaagtcactaaccaccctcttgagcacttgtaggtaaacaagtaggagcttgcataggaatatgatatcagggaggaaatacagtttctcctcaagtcataaatttgtagctgggacagatccctgtaataaaagacagattaacaagagaaaacaagcaggtttattaacgcatgcagtacacatcatgcaggggaaacctcagtgaaaggtaattgaaggcaatggcttagaactctagctcctacagcatcttcaacaaaataacaataaattctagagaattgacaaggcaaagaaagtagttttaggcttccagaggtgaaaaactatggaaaggtaaatatatagaagtaaactaatggagtaaggtttgtttgtggattcctctggtgccatatctgagctgacaagagttttctccagtaaaggagaatttatattccatctgtctgtatagaaaagaagggaggacagaaagcattcttcctttgtttgctgctgcctagctgtctttagctcaataatatttatgtcagagagacctatttggcatgacatattctggtttctgtcagtaggaaggcagatgccactgccacagtgggatggcagaagaaaactgacagaagtgcatggaaggctgttgtcccattgtcagtgataggcctggggacactggtgattagagggtcaggagttgggaagaagacctggaagcaaagcaagggaaagtgaggatgacctagagcccacatctgtcatttacctcctctacctatgatgaccttcccagggtatagggctgcctttggagacttctgttctgaccaaatctaaaacagaatcaaaaagcgaagaagccaaattgacccagtattaaaccactatgccaggaaaatggcttttttgttctcctaaaattgggccttttaacaaatgagatgactcccttatctgtccttaaattgtgttcactggagaaaaaagcacacttcacagatttgttgctctccactgggctggaattaagtcattttatccccaactctgatttttcattcagttgtctcccaccagctttgtgtaactgatccaagcaccaagcactagtagtctttggtccatctttggacaaacaaggagtctgtagcttttgtttctttggttgtctctgttcctagaagtcacattgtgaagatggacttgattgtgtctctgtttcttaagtaaagcctgatatagcgtgtaagccatttataggtgattctcaccttatcggtttatgttcagctgcacaaggacatcatgtgattattgtggtgtgagcactctagtagtaatttttatttggtgggtttgagaagtttttgatgctttaatggaccgggtgtttctgagctaggtttgtggacaagtatatcattttgtattcatagccactatttgctatataatctggctgttcatgcaacaatggctgcagggaagtagggaacaatagaaggaaaactctaaatattcagaaaaaggcaggaaacagaaaaatcgagcctgaggcagacagcagaggagcaaggtcagtagggaaggaagaggaagcattcttgtcaaaggtcgcacagtatttcagtctcctaacgttttaacatgtgtgatgaactccgcaagcaaaatccaccaggcttgctttattccacgtatgggctaaaaaagagtaagctctattataattcccaaattaatcaaccccagtctgagcagtacaaaatggagtttttagacaaaatgctgcaactaattcatacaactttaagcaaattgtttttgatctctgggcctccgctttcccaccattaaatgtggtgcttggattggattagagattacatattagcagccagtgggttctccctgtatatatactaactgaccctcgagttttgactataggggttttcgttcattttttaaaacaaaacaaacaacaacaaaaactagactctacattttatttgaatttcatttatttttctaattttttttttctatcccaagatttaatgtaggataccacaatgcttttagtacagggtgatttcttttaatggaattgtcaacattcaaaaagtgaaatatttcacataaaagatgtggatttcacacttcctttgaaagctcaggtgatctgatgtggatttcacacttcccttgacagctcggagaacaaaagccctgtgtttccatctagcagtgataagctggagctgagatgctactgctcttttaggcatgacatgtgccttcattttccccaatctccgctactctctattgcctcccagacaatgagaccaactgacaaccgccattaccatcacttgttacctcctcttgctatacagtgaagagaatatgaaacatctagaaaaagaaattgagcaagaacaaatttaaggaaataaaaatacacttaaataactgacttagttcattcatgctactgtaacaaaatactttagactaggtaattaataaagaacaaatttatttctcacagtactggaggctagaaagtccaagatcaaggcaccaagagatttagtctctgctgagggctgctctctgttactcagatagtgccttgttgctgtgtcctccagaggggatgaatgctgcgtcttcacatgatgaaagggatggaagagataaacttgtcccctcaagcccttttataagccagacatccattcaagagggcagagcctttatgcctaattgcctcctaaaggcctcacctctcaatactgttgtattgggaattaagtttcagcatgagcttggaggggacgcaaacattcaaatcattataagcaatccacttcactcatttatatggtcgttcagatccctgtggaaattttggtgtgaaatttctggacaagagcaccttttccatttttttcactgtggacatatgggaagtggtgtttggtagccagaccagagttctgcaaaaaactgtgagggtcttgcagatggggtctatcatgctctcttcttcaaccctctcttactgagggtaagggttttgagccccagacactcagtcaacatagtcctacttttgggctcttttatttcctctaagtctgggcttgggaagccaggttgcagcacaattaagaatatgggctttgaattcaggctaccccatttcaaatggtagcttccccacttcagaggcatgtgacttctgttcagtcacttaacctccctttacctcagttcccttttcataaaattgggctaataaatagaactgagtcagtaggattgttacgatagataaatgcactaatatatgtgaagggcttagacaatacctggcatgtagtgagtgcttagtgcatactaatgattattactaccaccattatagcatcaccccagtgttttaaaaccccatagtagccttataaaaatcccccaatcccagactgcgtcataattgtgaacatggtaaagagcactaggggatacaatttcgtgaaattgattgagcatactttatgtagctccagggaaaaatacaggccaagtaagtaaaagttagagggaaacagatgttaatgcaacataaagaaggcttttcttatgttcaaagctagaaagcaatgaagtgactgcttgtaaggtgatgagcaacctgtcacttatggtgttcaggcaaagactgaatgattgtagctaggcaagttgtacggcaaactggtagtcacaaactacatatgactatttaaatttgttacttaaaattaaataattaagttcaaatcctagctaaaagaaataaatattttaaaaattgaaatgaaattagaaattcagctcctcaaatacagtagctacacttgaagtgctgatagcaatagccacaagtggctagcggctcctttattagacaacacaaatgtagaacatttccaccacaatagaaagttctgctgaacaccgtcattatagagggatgtcctgcactagatttctgaatccagtatttgggttggaataaaaaaacaatttgatatactgggtgatatagcacttacctgcagactccatgatttcaggcttatgcatggccccaggaaaagcactgtccctcagcctcagtttcctcatatatattatatgattaaaacttgtccctaagggtggttgtgagtataaagggataaagctcaagctcagcaggtagcacaaggcagcgtacacggatgcttgggttctttctttctatgaaaggaaaggaaacatgtagagtcaacaatctcaggtacagtaaaacagccattttatgtagcctcccaaagagcaagatctttccaaaatcaatagctaccctagctaccatcagtgagcacttaaccgtgtactgggctgtaagctaaactccttacatgcagtatctgatttaattcccgccaccatcctgtgagatggcttctcacaccaaagatcctaaaacttagagagattatatgatttcccaagattataaagggctgtatacagaattcaaatgcagcttcttttgactcacgatgattgctacttataaaaattgatatatatggaatattacatatccatacacacatacatacatgcatacatacatatattgtgctaaacacatgaatgcatcatctcatttaatccttataggtactatgtgggtgaagaagttttgaaaatttaaatgctttgcttaacaattcctacccagaaactagcacagctagtatctggacccaagtctctctagtatcacgtgttttacagctgtgttcccaggctagcatccttgtttagaagacaggtgaacaaaacctttaaggttgatgtcactatggcctttgtcatgcagagataaagatgccatgtatgtgttttctcttgccaatcacactgtaaactcttttagacaagggttgtatctccagcatttatttcttctaagtctccaagaactgcacagactacataggattcaataactatttgcctaattagaatagaagtaaatcttctcagaaaacagattgacaagaaatgtttcttatttagcaacttacttgagtggaaccttgtctatcttcatgaagaaaagcaagtattcattatgtatatatttgttatcactttaaccattgatggatgcctgcagttaaggtggaagggtctgtttgttttcagaaaaaaaaactaggattaatagcaaggcgaaaaacacttgatgtcaaatctctcagaaaaccaaataattttttggtttgatttgttagttttggctgccgtttaattccttaagaagctagggtaatagttgtgtactttcaggccatttccaccccttctattgtgaagatggagctccccacactagtcggtgtagtgtttctctgctaggccagccaagtagaaaactccaattagctgacaagtggttaaagtgctgctgagactagacacagggggagaaaatggctcttgtcaactatattctttccaagcattctgattcttgttatgttgtgcaaaaggcagcctaagggtggactgacagggcatttttatatcccttttagagatgtaagtgtccctgagcttggagattcccaattacacctgttcaagttcccaaggaattatgaggaagatgatctgttttagtttagatttgggatcttggaaattggagagataatttttctttaagaggtgatagaataatatcagattacagaagccttcagatgttacacaaaatgtttaaatgtactttacatgttgcttcatgtgccttcttgatattcttacaaaagtattatgtattcattaaatggattatcagcagattgttttggtagtattttcagggaaccaacattcaacaaggctgtttattcttattatagcaataaagctaaaagtcaaattctgctcccagaattactgaaaacaactaagtgtatgtattttcagacatttttctatgcttatatgactttctgtatacataattttgaattgtttttatttaaaacactgaatcattctagttctattgatttttattttttttatatcctggagatcttcatgtcatcttattgagctaataatatttacaattatacccagttttattattgatggcataccatatgtcaaattctgtactaagatatttacatctcattaacatttcaacaaatctgaggcattattccagttctatcattgttttcatctaacaggcagggaaactgaagcttgagaggtcaagcaacttgcccaagaaaaactagtaacaggtggactctctcagacactgtatgatatggcttccctttttaaatggttacatattatttcattgtttgcatgcctcattatccccacctccaaggtagactgattgtctttcccccataccgcaaatctatggtctactctccttccccatccctgcagctgctcacagccctcagatggagtttttgctggtgaataaatgctgcccttcctttaaaataaaacttgtagccttcaggatgacagagcctatggcatgtattagtgataccttgctggttcttaggtaaacatgtagcataatggagaagatgataatccttctatgaccatttttgtaaactgttgtcaccaattgagtgatctgaattgattttctgtttccagcctacctaagaagtttaatcccacctaaagcaataatcatccaacttgatttagaattaatcaggtatcatcttctgtcaaggctatggccaatctgccactttttgtcctgggtctcaccactataacaaaatgtcttttccttgcatgaatttgtttgacatcataagctttgtacccagagcactgttgtctactcttgggccagatatcatattatttatgctacccttctccatggagaaatttccttttttattgttcacatatcatactgcaaatacatgaagttcttccagtatgccctatggcaaaaggtcaatattcttaaaatcatgttaatcaaaaattgcagaacagacttcagtaatgcttgggttggccactgtgataggcagaataatgatcccgccaatgatacccccacaatccctagcacctatgaatatgttaccctacaaggcaaaaggaaaattaaggtggcagatagaattaagcctgctaattagttgattttaaaataaggagattatcctgaattatctagcttggcctaatacaaatacaaagggatgcagaagaaaagaatgcagtgatatgctgtgagaagaactcaatctgtcattactggatttgaagatcaaggaagggaggccattcaccatggaatgtgggcagtctctaaaagccagaaaattcaaggaaatgaattctccactagagcttccaggaaagatcacagccctcctgacaccttgagtttaacccagtgggaccgatgttaaacttctgaactacagagctgtaaaataataaattggtgttgtttcaggccaccaagattgtggtaagttgttaaaacagcaataggaaactaagccaccaaatgccccttcatggagctaaagtttatttcactgtcaaaacagagggctttttccattagacgaaccacttttctagttttataaggaagcatttcgtagaatctattagtgaggaccttgatatgagacatattgaataaaacatgtataaactgaacacaaaaatacaagtgtgctcccttataagatattatatgaagtggggtcatgggttcaccattctgttactgtatgttttttagacccccacttgtatttatcaggatcaatcaatgcctctccattatttgcagctatgattgaagtatggtacagattttccctcttgaacaataaaagtacataaccaactttgatggcacttcagttccatgcctcctcatgctaaatgtcgtggtgatttggcagagaatatttactccacagatcctcatagaggtgtgtgacgtgtagagaatagtttgactgcaccactattagcatcccttttgagcaaccatttgagcacatgcaagacttttatgattaacaatttaactatttagtagaatataggtgcttatcctctctaggctgtttgcctggttacagccataatataacatgttatacattgtggtattccagtacatatgttggcataactaagttttcatcatagagcaagatgccaaattcactcttcacccgatatttagagacaaaggaatgatgagtagaaggaaaagggcacaaagtagagtagcggctactcggtggttatgtcatttagtatggttgttgggttttttttaagtcacaaatctgctcactcagcagactgaaaatttcaagttggtaccattaatattgccacagttagtcatttgaaatactgtctgtacatgtaagtatgacacatgtttctatttaaactcacagcttggcctcctatgaagattcagcaatgctaaaatcactgagtcatatggaaatgctcacattttatgcagaaacaaaatcactgtactatacattagcattttgacaacataatgcagccatgaaaaaagtttggtactctaatgaaaactagaagttattaaaatcagttattattcattgaatattaagctggcgagaggcttttaaatcaccaagtttaatattcataagaaacacatgttatgatttcggtcttctgttttgacgatggataaagtgtggtatagttttatgctaaagaaataataaggcaaaatgcacttttgctgaaaactttaattactgtcatctaaaggatgacctcacactggccttcaagtattaaaataattattgtataggtgggaagtcagaatcaattggctgcatcacgaagtgttgagcaagaaaaaaaacagcattataaaaaagaatgaaattgtgtcatgcagcaacattgatggaactggaagtttttatgttaagtgaaaaaccgaacacagaaagatagatgccatatgttctcactcacaggtaggagctaaaaaaattgatctcatggagatagacaatagaatgatagatatcagaggctgagaaaggtgtgtgagtgagtagggttacagaaaaagggagggtggttagtgggtacaaacatagacaaaaaagcgccaatgttcgatagcagagtagggtgactatagttagcaacaatgcattgcatatttcaaagtagctacaagagaggacttgaagtgttatgggctcatagagatggtaaatactcaaagtaatggataaccccatattcctgatttgatcattacacattatagtcatgtaacaaatacatgtcccccctaagtgtgtaaaatattttgtatcactaaaaaaattaaaatggaaaacaaaggaaaaaaaaaacaagattaaactgtaacccaacagaactgggtaagacatgagaaagaaagcaaaggagagaacccacatttcatgagcatgtattatttgtaaccttttgtgttaggtgattttgcacattatttaatttacttgtgacacaaaaatctgtgagatttatcttatgcccattttacaggtggcactgaatctcttgagagggtaatgaatttacttgagctcacaaaggcagtgagttgcagagttgtgtaaatccaaaatcaatgatctttttactaacatggtgtcactcatctattaaccattccaaccagtccccaacttagcactaaataattttgaaaactaaaatggctgtctagtagagggagaaaatgtcttttacttctttctttcaatggagaatcaagcaataaggttgggttgggttttgttggtatggagtttataaattgaatttataaactatacctatgaatttataacatacctattatacactttctcaatgtacaaactgtgccatgctggtttctgaggaagatggaaacatgatttgtgctacaggcctagagggactgcaaggtgtgtattgggcacaagccataatcggagtctatactaaatgctgtgagagttaaaaggggatgtcattattcactttgctcctagagacttgcaaagcaataaccacagaggtggcattttggctgggctttgaatgataacattctcacggactgaagacggagaaatggtatcttagattcaggaaacagcacaggcaaaaactacagagaatcaagctataatgttgggtttggttttattggtatggtgtttatggacttgatttaatacatatctattggacaccttctcaacgtataagcttctgagctggtttgtgtttggtttgtttgccaaaaataaataaataacaggaggttaggttcctaacaggaatggagtggaaatgcagttcaacccttcctgcagtgaatgtgaagtcataaggagtttctaagaaggggctacgtaacagcaagctgtctgagggttttagaaggcagaaccaaaaatcagggagacaagtggttggtggatgatatcactcaccaggaaagagatgatacggtaggttctacaaatgtgtgtagttccaaacacattttactctgaaattaaatgtggggcatgtcatagtacataacgagtaatagaatgagaatataaacagttttaaagcaccttaatcccaaattagatttcttccttttttttttttttaacgatgtaagccctgtcttgcaggctttttttttttttttttttaaatacagtttaactgtcctgactttaaaattggttgaataaaacttttctctattttggatgatattgccaattacctactggggaattcctgatgttactctttccactagtttatgatttccactcaatccttggctcatgttattacaaagcctgagagctggttttggaatgcatgcctggcacatggtaggtgttcaacatttgttaatttgggaagagtgagaaggtagaaatattcgagctgggctcagtgaatgaatgagagcggcacacatgaaaatgagaaggaagtgactttgaggcagagaaaatgaaccacgatgggtcctgggttgcacctttctgtcctctgtgctaggacctgtgctaaatggcttacataaattattttatttagtctttggagcaaatcttatgaggtagagtgttcccacttgatagatgaaaacaccaatgttcaaagaggctgaatgacttttctaaggcctcccagctaatacatggaaaatgggaattcaaagtccgaaagacaagcttttgatctttagggtatcttgccctatccagagaaagcccaaggcattttttaattcttctaacccttttctgagaaaatacaatttgaaggaagcataaataagaaaaacttttgcaattttaaaaatgcatcctgcctgattttctttagaagactcatcccggttctttttaaagaagtaaatcattatgcattggctcattttcttgcctggaataaccaatgaaatctcccaatatatccaaaaagaaaggcaagttatagcttttttctttatgagtacgcaaactgaagacacaggcagccttgcgggatttctcaaggttacaacattgcgaacataagtttttacccattaccttactctgcagtgtctcaggggtcacattgtctctgtcttgttcaacatgccatgaaaaactgtttccagctgatggatttggtggcttgaaagcatgagctactagaggttaggaatctcagaaatgaagattgcacagtgtgtttgagagtaattgttcacaggaaaaaagctgagaaatttaccctctggggctgggaggagtgacaacagaaagtgaaatcagaattaagtgtaagtgaaggccttgttgctatctcccacctcagctttaagtcagcacttaggacagaaggatatagctctcagaatatcctgtaatatttgtttaaaatacagatccctggacttcaatccagacttgctgagttagggcttcccagggacaggccagataactgggcacttaccaggtacttttggtgattcgtcacaggaaactttagaaaactacgattaatggcagttattatttacactccatagcttggatactgtgtttgattcaggaggcacatctccaaaattccaaaaaagaagttaaaaaatgataaagaacagcaccgtaaagagagatttggtacaaaaacttaattaaagagggtaaagataataaagagaaggatgcatttcaaggggaacatttctagaggaacgtatttatcttataaacttacagacatctaagtttaaaatgtataaacatgaaagtttctagggaaactgagatgtatatctaagaaaagcatagactatatattcttcaattctgttttttcattgtaaatttggggtgaagttaactgaaataattaacataactaacattgaaatactccttcatatgtgccaggcagaattctaagaactttccatatgttaactcttctgttaacttctgaatctttccaacaaccctatgatatgaatattatttttatcctcattttataaatgaagaaactgaggcacagagaagttcagtcccttatcaaaggtcacacagtcagaaagtggcaaggcagggatttgaacctaaacatgtgtttgcagaatctccactgcatcctttatttaaggtgataatcggcttgtctgtaagggaccttatgattttgaccttgatcatgaagctgaaagactcgtttattggagtggggcacagtttgttatattaatagtagttgtgtttgttgtagcagttcatatacactaagcaagcaatgtgattatcacttcgtatacattgtataatgaattacccagtaagtatactgaggtccattttgcagatgggaaaactgagcttcttacctatgatcctaaataattttcataagatacacagacagtaaatgatagatctagatcttgaacatttgtctctctgactataaaacccattttctggccgctctacctgctgctgcttatggaatcaatattggtacccagagaagttgaaacctgaaagttacatgtgacttctaatgaaaggaccacagctaaagatatttatagaacttccaaattacagaggcaggtaagaaatatggtttggatgctccaacactacaatgtataagatattttgacaatgagaaggatgaggagttaaggagggagaagggatgttgacccaaaaaatcaaggatgtgagttactatgtaggacacttcaaataaagatgggtgtattagtccattttcatgctgctgataaagacatacctgagactgggtaattgataaagaaagagatgtttaatggactcacagttctatgtggctggggaggcctcacaatcatggtggaaggtgaaaggcacataatacatgatagcagccaagagagaatgagtgccaggtgaaaggggtttccccttataaaaccatcagatcagccaggtgtggtggctcatgcctgtactcccagcactttggtaggccaaggcgggcggatcacaaggtcaggagttcgagaccaaccagccaacatagtgaaactgtgtctctactaaaaatacaaaaattagctgggcatggtggcacgtgcctgtagtcccagctactcgggaggctgaggcaggagaatcacttgaaccccaggaggcagaggttgcagcaagccgagattgcaccaccgcactccagcctgggcaacagagcgagactccatctcaaaaaaaaaaaaaaaaaaagaaaccatcagatctcgtgagacttattcactaccatgaaaaccatattggggaaaccgcccccatgattcagttatctcccatggggtccctcccacaacacatggaaattatgggagctacaattcaagatgagatttgggtggggacacagcccaataatatcaatgggtgagtgtcctttccagtttccctcttgtctgtagctgagtccaacagagaattgtcacaggatgagtgtgaaggaaaacagcttgaaatcttgactttcagaaagaacagagggcacaaggattcttgtgtaaagcagcaattcatagtcttcctttaacatccttacacctagtacttgttttcaaaccattacacaatgtagtgttgattcttcttaagcatatatgtctgcaatggagaaagggacttcgctgggtggaaatgtaaagaaccatgaagtagtgtaatgtagtggatacaaacgtattatcatacctttccttacaggcaggcaatatgtggcagggcttcaaaacagaggtttcaagaccagacagttcaaatccagctttggactcgggacaggttattgaacttttctaagcataaattttctcttctatacaccaaaaagaatgattttactcatctaggttttgtgggttttaaatgaattaaatgatgtgtccagtgaagtgcctgatttaacagtatgtgctcaataaacagaactcacatttattattagaagcaagatttagaatgaaaaaccaggaatcatatctgtctatctagagcctgatcatgttcaaatgtgtttgtattctgacctgtcaattgtgacactctggacattgaccctgactcaaggtctccagaactgactgtccttaccccccagttctaagttaaccatagttttccttaccccttaagcaggaatagggatcttatttaagatcattataaggtgctacattcccttatggggtggttgtgagaatgtagtagattacctcatgcaaagcaatttagatcgtgctagcacataaatgatgaggttgcctatttttaagacccacctgaagctttaagtgggatgtttctggcacagaaatctcttcaagtgtaacgtaatctacgtccctcattggaaatcagaattcttgtaaatgacagtgtcattcttcagtaatctcaacctgtttaccagcttcctgcttaacatggtaaagttgccttataaaatgtgaaagatctctttaggctttaataatcttgcagtggtgagatttaatgggacaaaaggaaacaaaggttaggtcaaacgcactttcaagttgtttagtaacaactttcagtgtccatcagcggtcacataccatgattttcctccactgggagtcaaaggtgaaacatgtcaagaaccacacaagtcacttgtaagcaaagagacagggctggaaaagctgtgatcatcaaagtgatgttcctaatatctgacgaaactcatgttgtgattcagtggtacacaacctcggacacattataatcgcctgaaagattttaaaaatctagtccaaccataccccagacaaaataaaaggctctctgtggtaggacccatgcatctgctcgcttgtgttgcctgtttgtttgtttgtttgtcttaaaactccctgggtgattctaattttaagccaaggttgagaagtgggatataaaagttctaataaggcaggttctaggaaggagacaaaaaaataaaggacaactgcttgggtgaagggagtggttctattgtttgtgtaactaatgttcaacattaatggctcacttagctgctgcccatatctagtggtgaaacaaattaactcaaatgcaaacagcttatttatatgtacatattcccatacatttatttgaatccccagtgatactctaaaagctaattacaatgaaaaataagccattctacgtgtaaatatacatgtaattctgccagttaattgcctgaaattttcattttgttcacattcccaagtgaaaaacctcaggatttttttgtcctgaagtaacagacaacttgtgtaatctttaaaagtgtgcttctcctcaccattgtctcttaatcaaattaaatttatgagatgaaataaacccaatacattaatgttagattaatatatgttttctctggttagtttttaaacaagggaggtgctgagcagtatggaatttgatcccataaagagaataggtgtttctcagtccctggtgggaggtttcacctttggggccagaattttagtgactttatcactagaccgcaaaatcatttctgatgggccttgaagcccttatatctctgtggcccatgtagataacatagtctaagtaaaaagaaatcccattacacagaacatcataaagacagcagggatgtcagactgtccactaaccagaggccatcttgagattttttttttttttaccgttgtctttaatagaaaaagaaaaccatgatgattctacttatctcccctattccctccttcatttcctcaatattattttgtattgacttctttgcacaggtatatgtgggaaggggaacccaaaataaaaatccatttcatctctgccaccaaaatctccaccaacttacttttatctaaacccaagggaaaatgaggggcaacacatttgtggagcagttactattcagaagcaaggcagcatcacacaagaatgtattctgaattcgttgcttataccagtatttctttcctgctgttttctccgtgaattaacttgatagtaggttctggactagtggatagtgggagaattatgaaagcatctgatgaacataaaatttattatgtagaatatatcaaaaatatatgtaaatcactattttattgcttgatatgaccttacgatattgtcaaaatagatagcctatattttgctatagcaggcacttcacttctttaaaacacattttataatatcaacctttcatgcctagttagaagagagatgttctggaacacttgtctagcacacacttatgttggtgcaggcacacacacacacacccaaaataaatctaatgtgtcttggatataaattgttttataatgaaaggctaacaaaggccaccaaccattgtaataggtaagatgagcttttgacaaatccttggatcggagtatcttttatagttgatatgaagaaaaaggtgatgcattggctggcattatatctcaatacattattgctgaagtttaaaaaatttactaaagtgaattttcaatttattctttgcaaagaaatcaggcctacaataaggatatgtgtatttaaacaaatgattgaagttagcaaaatatttatgaggtccacatcttaaaattggtgctatcaaccctgtcaccccattggttgttagccaatagtagtcacagttcaaagatgatattgtcctatgtagtttctgaatcgttgttttcccttagccaattccattttatagcccttgttcaatttaaatactccatttcttagggatttgccatcactcactctcacattgttttcaatttcaatataaattgatgctgcctcttgtgttgtttctccaaatactcttcttgttaaacaagatctcctgtttctagaatggtgtgcacatttgcacattctattagaaaaaaaccagattccctctcaaaatatttgcaagtgccacaccttcaaaacacaagacagatcctccattcagacaatagaaaagaaaacaggaccacccatgtgcttttaaggcactcaggaagctgaatgccgaaatgtatatttgttttaaaatatagatgattgatcatttctttaaaaatgttttgggccaggtgtggtggctcactcctgtaatcccagcactttgggaggccgaggcaggcggatcacaaggtcaggagattgagaccatcctggctaacacggtgaaaccccgtctctaataaaaatacaaaaaattagcctggcaatgtggcaggcgcctgtagtcccagctactagggaggctgagacaggagaatggcatgaacccgggaggcggaggttgcagtgagccaaggtcacgccacttcattccagcctgggcgacaagggagaccccatctcaaaaaaaaaaaaaaaaaaaaaaaaaaaaaaaaaaaatatatatatatatatatatatatatatatatacacacacacacacatatatatatacacatatatatacacacatatatatacacatatatatgtacacacacacacacatatatatacatatgtatatatatgtgtgtgtgtgtgtgtgtatatatatatatatatatatatatatatatatatatatatatacccacatatgtattttggagcctgaagttaaccagagtgaaatagctcaacttttactgcaaaaactcaaaatgaattgttaactatttaagaaatgttacaagtaggatgatggagttccttttctaagtgtgtgggaaattgaaaatcttatgagaattagaagttatcttcatgaaactacatataagagccacaaaagtactcctagacaattggagaatgactgttctctttgttaaacctcctcgggtgttttcgttgttttttttttttttttttaattgtctggactcataatccctgaatgagctggggagtgccagggaataatctataattttaattaactatgatcatgtggttgaatcagtttgagaagatattttggggtataatcttctagaacattgcttcgccttttttctacatttaactgtttttgatttgcttctaactataaaattgaactaccgtaataatctagaaatcactgaacaaaatgcacaacaggccaagcaagtcagaaatactctatttttcttatctactcttctgttaagaaaagattgtaatttttcctcttctccccattgatgcaatgtaaataagcatgggtccactcttattataaagaaaactactctgagcctctgttttttcattggtaaactgcagacgattcttatttctttttttcatttttattttactttaagttctggaatacatgtgcagaacgtgaaggtttgttacataaatatacatgtgtcgtggtggtttgctgcacctgtcaacctgtcatctaggttttaagccctgcatgcattaggtatttgtcctaatgctctctctccccttgcccccaacccccaacgggccccagtgtgtgatgttcccctccctgtgtccatgtgttcttattgtttaactcccacttgtgagcaagaacatgaggtgtttggtattctgttcctgtgttagtttgctgagaatgatggttttcagcttcatccatgtctctgcaaaggacatgaattcattcttttttatggctgcatagtattccatgatgtatatgtgccacattttctttatccagtctatcattgatggggatttgggttggttccaagactttgctattgtaaatagtgctgcaataaatgggtttttgtgaagttaaaatgtgtgaaatcacctaagatagatgttgcaaactcaaatgcgcacaggatgcataaaatttaaaaataaacaaaagtggccaagttggagacagagaagagtgttagagaatgttgagaactggtgagcacacactgtttttaattgggaatggtgctactggtcagtgtcagtaccagctaattgctcccatggggacatggtgatccagtgctgctcaacctgatatttttcagagaaactagaaatctagattcttatgtgaaattctactgtgactaatttaacacttctgaacatctcgatgtaggctagtatctaatgggccaaactttgtaggcagtttgagatctgcagtctaacacatagaaagtatttgataaaagtgcctccttatttctcccacttttatccaaacttttggataaatatttaagttatttaagatgccccgcaggttgaaaataagtgaacaaagaatcatagacattagtagttactggttgggttttgaaatacaataaggacagtgatgactatttttgtggtctggccaaacccccaggaatctctgaagaacatagccttgcattatttggacttctctggcccctgatggcagtatgatggtttagtgacagccgaaaatgtacacgcaagtaaagacaagactgttgtggacgtggatccagacttaaatggagaataatcagtcccagaaactgacagtatggaagcccaaactctgtgttaatgagcactttgatgaagagagccaggtgggtttgaagatggactaccaatctttggtgttcctctgggcatgtggtcaaaatgccatttttactaattgttaatcacatgacaaatagcctagcatgcaaccagcaggtgatatgaaactgcaggtgaagaaattctagagcataatgcagtatagccttgttttcaggaagaagccaaaactgagctggaaaaacacaatttgggaaataaactgcaaaaacccacatgcaagaaagtttgaattaataaaatgaaatagcagaatcaatcagacagaaaacaatacatttagcactaagaaaaaaaatcagctatttggaaaaaaaagtgaaagccactaaagaatagccccaataagaagctaagccaaggaatcctcatacaggttgtggaagcatgaggaagaaaaggtgttcacaaatattgcatttaaaacgatagtaaacaggaaggccgctgcctgttcagacaggaacatgtagggtgcctctacctagatgaggtctccaaagcccaagaaatttgatcatccattacatttgctctagtactcactgaattgtaagcatcaggaagacatagatactgctttttttccactggtgcaattccagcccctaacacagtgcctggcacatagcaggcacagagaaaatatttgtgggaggaatgaatacataaataagttaataaaggaattaaatccaacaatttgatttggcctaataatggtacctactatataaggaacacctactaagtgcccagcttttatgttatttcttattttttaattctataagggaagaagaacatatatttttattctacagaggaaaaaactgaggttcagaaatcatgagtaactaaattaaagttacatgactagtaagtggcaaaagtgagatttgaacatgtggttatttaaccctaaaaacttactctttcattatgccattctgtttagcttcatccatatcaactcagggagagggactcaagttgttcaaagaaacataagacttaaatccaggttatctgctctaccccctttgccctttctaaggtaccccatgccctctttctgctttgttttcctcattgaagcccttggcaaacaatatcttttgagcatgtttcacacagcagacaccagcacgctctacaagtgtaataaatgctgatgtcagagctaccataaaagacagaagtcatttcattttacatcaagatacgagtcaccatctggaagaccagatacgccaatcttaatttgagaccagattttcaaatctaactccaatgtgaaggaaaagcttatcagtattcaaagtgaagacttgggtcactctgcctagcaaacattcattttgttaggactccctttcatgagcaaaagtaaacgcattctgcaaacagctagagctcctttctgtattggttcagactcttgtttgacaggaatagaaactcacttgggcaagaatacaacacaaggaggaaatttattataaggaaatacaatgtctcccggaacctgagggcaggaatgcatctgagactcagaaatagaccaaagatggtgtcaccctcctctttgcatctctaccctgcaaattagctttctctgcttctcatcccacatggtgaaacgtagccacccacaactccagtgattaaatgctgctatttaagagaccagtcagatgcgtgtgagaattctaaatccactttggtgcagcttgagtcagtttcccactcctggccaatccactgaggtttggtaggcaagggtcatattttataaacatgatcatactttatatacacggtgaccatatggatggagcagagctgaaaagggcttgtctctgtaaagaagaaaggagtgagggggagtgagttctgagcaagttaaccactctcaattgccttctgtactgttatctatatatactgatacaaagaaaaataactcttctgtgtacaatcaaatgcaaaggtgaaatttaaagtgagagttcactgattataaaggttttaacagattaatattttaggacaataaattggctctttgagtactctacaattcagcatgtcttgatgcacaaaatgacttttaaaactcctgtaaccattccatcatctataaccccatcccatgtatttctaaaaaccgcaatgctgtgtcagcatcatggtaagcattcatcttatgatttggtattgatgaaagtcggttacttccaggtctccctgctgttaagttactttttatgctttcttgtgagatgaatgtctccatccctgctaagaactccagctcagcctttgcatattatctcaatgatctcagacactttatctctatacattctttatggatcgcattactttcaacacctcttatctcttgcctgcaaaatcatcctccagtgcaaaagtacaagaagagcattgtctccaaccacctttctctctcggtgatggcttcgtcaactctccataggctaatcacatttcagaataatgctgtttggggatgaatttatctggtgctgatttatcaaaaccaaatctttgtataagaagattctcttttggcatgattctaccagatttttttgtgtgttcccacctgaactgtaattctcccaaacataaatagccttctagcctcatttttctctctgcttttggatcagtgcttgtcatcaaaggcaagagcttgcttttgttaggagcaggactgttttctattgtgtatcccactccagacagtggtgttatcatttgacaatatctctcaggactttttattaccatgcaactaagttttaaacctattttgattcaaacgaagttgattaaaatcattaagtgctggcttatccaataaagcatattcggagtcattcagaaaatacatattggcatacttactccacacaagtcagtgggcaaaaaagaatggagatgaatcagatgttgtccctgaccttaaggaagtcgtgatctatacattttgtatataaataagcccaatcaaatttcatgcctgggaaaagtcaatatcagattaacttatagatgatttccaaggactactatgaatcattcttttctttgttcaattcaattcattaaaacagatgtgaagtctgctttttcattcttaacatccttatttaacagtaataactaatactttttgaatgttctctgtgtatcaggctcagtgctacatagtttacatacacaagtgattcacatatgcagccaagtttgagaccattgctatagcctattttttgtatgtgcatatataaatatcccacagaggcttctaatatacaatggaggggaaagaaaacctctgattttagctctactgcagtcaaaagtgaaagaatctctaaagaagcagccaaagtatttatatatttttaaagccttcgaaaggcacagccagagagtttttaagaaccatctcctaattaagtgatgtttttcattgaccatctactctgttttaaactttatctattgtttgtctttgcactagtatttgttgtatcagcccatctccaagggtctgcacaactgatcaggatataggccttttgagctccaggtcctcaatgttaatcaattttatgatattcttgagctgaaaagggacatttcattgcagtgtttaagtggttcagtgtttaatcttggaatcgagttatttggaattctatcctagttctttttttttttaacttttattttaagttcaggggtacatatgcaggtttgttacatagggaaacttgtgtcatgggttttttttttacagatcatttcatcatccaggtattaagcccagtacccattagttagttttcctggtcttctccctcctcccaccatctaccctcaagtaggcccctgtgtgtgttgttcccctcattgtgtccatgtgttctcatcatttagctcccacttgtaagtgagaacattcagtatctgattttctgttcgtacgttagtttgctaagaataatggcctccaactccatccatgtcgctacaaaggacaggatctcattcttttttacagctgcgtagtattccatggggtatatgtaccacatcttgtttatccagtctaccatgaggggcatttaagttgattccatatctttgctattgggaatagtgctgcaatgaacatatttgtgcatgtgtctttgtgatagaatgatttatattcctttgggtatatacccagtgatatggtttggctctgtgtccccacccaaatctcatatctaattgtaattcccacatgttgagggagggaggtgattggatcatgagagaggttttcccccatgctattctcatgatagtgagtgagttctcatgaggtctgatggttctataagtgtttgacaattcctccttcacatgctcctctctcttctaccaccttgtgaaaaaggtccttggttcctctttgccttccaccatgattgtaagtttcctgaggtttcccaagccatatggaactgtgagtcaattaaacatcttttcttgctgaattacccagtctcgggtatttctttatagtagtgtgaaaacagactaatacagtaaagttgtaccacagagagttgggtgctgctataaatagatacttgaaaatatggaagcaactttggaactgggtaatgggcaaaggttggaacagtttggaaggctcagaagaagaaagtaggatgtgggaagtttggaacttcctagagacttgttgagtggttttgaccaaaatgctgatactgatgtggacaatgaaatccagacttaggtggtcttagatggagctgaggaacttatctggcactggagcaaaggtcactcttactatgctttagcaaaaagactggcagcattctgccctgccctagagatctgtggcacttttaacttgagagagatgatctgaaattggaatttatgtttaaaaaggaagcagagctaaaagtttggaaaatttgcagcctgatgatgcaatagaaaagaaaatcccattttcttggtagaaattgaagctagctgcagaaatttgcataagtaacgaggatttaattgttaatcgccaacacaatggggaaaatgtctccagggcatgtcagagatcttagcagtatcccctcccatcacaggccttgcagcctaaaagtaacaagtggcctcaaagcctaggagaaaaaaatggtttcgtgatttgggtccagagtcctgttgctatgtgcagcatcaggattttgtgccctgcatcccagctgctccagctccagccatggctaaaaggagccaaggtaccactcggcctgttgcttcagaggatgcaagccccaacttttggcagcctccacgtggtgatgggcctgtgggtacacagaagaattgaggtttgggatcctctgcctaaatttcacaggttatatgaaaacgcctggatgtccaggcagaagtctgcttcaagggcagggccctcatggagaaactctgctggggtagtgtggaagggaaatgtggggtgtgaggccccatacggagtccccactagggcactgcctagggagctgtgagaagagggccaccatcctctagaacccagaattgtagatccactgacaccttgaaccatgtgccttgaaaagctgcaggcactcaatgctagcccatgaaaaggctgccatggctgtgtgagctcacatcttgcatcaacatgccaagaacatgaaacatggagtcaaaggagatgattttggagctttaagatttaatgactgccctgctggattgcagattttcatggggcttgtaacccctttgttttggcgaattcctcccacttggaacaggagcatttacccaatgcctgtaaccacattgtatctaggaagtaactaatttgcttttgattttttaggctcataaaatcaagaatggcagaagggacttgccttctctcggatgagactttggactgtggatcttcgaattaatgcaggaatgagttaagactttgaggactgttgggaaggcatgactggttttcaaatgtgaaaagacatgagatttgggagggtctaagagcaggatggtatggtttggctctgtgtccccatgcaaatctcatctcaaattgtaattcccacgtgttgagggagggaggtgattggatcgtgggagaggttttcgccatgctgttctcatgatagtgagttctcatgagatctgattgtttcgtttcgtaagcaaagcctttgacagttcctctttcacacactcctctctctcttgccaccatgtgaagaaggtccttgcttcccctttgccttctgccacgtttctaagtttcctaagacctcccagccatgtggaactgtaagtcaattaagcctctttcctttctaaattacccagtctcgggtatttctttatagtcgtgtgaaaacagaataatacacccagtaaagagattgttgggtcaaatgttatttctgttttcagttttttgaggaatcaccacattgtcttccaccatggctgaacaaatttacactcccaccaacagagtataagcattactttttcttcacaaccatgctagcatctgttattttttgactttttaataatacccattctgatttgtgtgagatggtatttcatggttttcatttccctttccctaatgatcagtgatgttgagcttcttttcatatgattgttcaccacatgtatgtcttcttttgaaaaatgtctgttaatgtcctttaatgggattgttttattcttgtaaatttgtttaagttccttacaaatgctggatattagaccattgtcagatgcacagtttgcaaatattttctcccattctgtaggttgcctgtttattctgttgatactatcttttgctgtgcagaagctctttagtttaattaaatctcttttgtcaacttttgcttttgtcgtaattgcttttggcatctacatcatgaaatctttgcctgttgctttgtcaagaatggtattgccaagtcgtcttccagggatttttagaggtttgggttttacacttaagtctttaattttaaatgtaggttgtcttccagggtttttacagtttgggtttttacatttaagtctttaatccattttaagttgatttttttttttgagtctgtctccaaagttctttttttttttaaattttattattattatactttaagttttagggtacatgtgcacaacatgcaggtttgttacataggtatacatgtgccatgttggtgtgctgcacccattaactcctcatttagcattaggtatatctcctaatgctatcccttccccttccccccaccccacaacagtccccaatgtgtgatgttccccttcctgtgtccatgtgttctaatcgttcaactcccacctatgagtgagaacatgcggtgtttggtttttcgtccttggcaatagtttgttgagaatgatggtttccagtttcatccatgtccctacaaaggacatgaactcatccttttttatggctgcatagtattccatggtgtatatgtgccacattttcttaatccaatctatcattgttggacatttgggttggttccaagactttgctattgtgaatactgccgcaataaacatacgcgtgcatgtgtctttatagcagcatgatttataatcctttgggtatatacgcagtaatgggatggctgggtcaaatggcatttctagttctagatccctgaggaattggcacaccgacttccacaatggttgaactagtttacagtcccaccaacagtgtaaaagtgttcctatttctccacatcctctccagcacctgttgtttcctgactttttaatgatcgccattctaactggtgtgtgatggtatctcattgtggttttgatttgcatttctctgatggccagtgatgatgagcattttttcatgtgtttttttggctgcataaatatcttcttttgagaagtgtctgttcatatccttcgcccactttttgatagggttgtttgtttttttcttgtaaatttgtttgagttcattgtagattctggatattagccctttgtcagatgagtaggctgcaaaaattttctcccattttgtaggttgcctgttcactctgacagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagctagttttcccagcaccatttattaaataaggaatcctttccccattgcttgtttttgtcaggtttgtcaaagaccagatagttgtagacgtgtggcattatttctgagggctctgttctgttccattggtctatatctctgttttggtaccagtaccatgctgttttggttactgtagccttgtagtatagtttgaagtcaggtagcatgatgcctccagctttgttcttttggcttaggattcacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttctttgtagcctcttttatttcattgagcagtggtttgtagttctccttgaagaggtccttcacatcccttgtaagttggattcgcaggtattttattctctttgaagcaaatgtgaatgggagttcactcatgatttggctctctgtttgtctgttattgttgtataagaatgcttgtgatttttgtacattgattttgtatcctgagactttgctgaagttgcttatcagcttaaggagattttgggctgagaagatggggttttccagacatacaatcatgtcatctgcaaacagggacaatttgacttcctcttttcctaattgaataccctttgtttccttctgctgcctgattgccctggccagaacttccaacactatgttgaataggagtgatgagagagggcatccctgccttgtgccagttttcaaagggaatgcttccagtttttgcccattcagtatgatattggctgtgggtttgtcatagatagctcttattattttgagatacgtcccatcaatacctaatttattgagactttttagcatgaagggttgttgacttttgtcaaaggccttttctgcctttctatctctattgagataatcatgtggtttttgtctttggttctgtttatatgctggattacatttattgatttgtgtgtgttgaaccagccttgcatcccagagatgaagcccacttggtcgtgttggataagctttttgatgtgctgctggattcggtttgccagtattttattgaggatttttgcatcaatgttcatcaaggatattagtctaaaattctcctttttgttgtgtctctgccaggctttggtatcaggatgatgctggcctcataaaatgagttagggaggattccctctttttctgttgattggaatagtttcagaaggaatggtaccagctcctccttgtacctctgtttaagttgatttttgtatatagtgtgaggaacatgtccagtatcaatcttctgcttatggttagccagttatcccagcactatttatttaatagggaatcctttccctgttgcttgtttttgtcagctttgtcaaagatgagattattatcgttatggggccttatttctgggttctctattctgttccatttgtctatgtctctgtttttgtagtagtaccatgctgttttgcagccctgtattatagtttgaagtcaggtagcgtgatgcctccagctttgttctttttgcttaggattgcctttttgagcttttttatggttccatatgaactttaaaatactattttctagttctgtgaagaatgtcattggtagtttaatagaaatagcattgaatctacaaattgctttggacagtatggccattttaatgatattgagtcttcctatacaagagtatggaatgttttccatttgtttgtgtcatctctgatgttgttgagtaatgttttatagttctttctgtaaagatctgtcacctctctggttagctgtattcccagttattttatgttgtggctgttgtgaatgtgattgtgttcctggtttggctttcagcttgactattgttgatgtataggaatgctagtgatttttgtacattgattttgtatcctgagacttagtcaaagttgtttattagcttaaggagcctttgggctgagactatagggttttctagatataggatcatgtcatcagcagagagggatagtttgacttactctctttatttctttctgttgtctgatttcaccagccaggacttccaacactatgttgaataggagtggtcagagagggtatccttgtcttttgcgggttttgaggggaaatgttccagcttttgccaattcagtatgatgtcagctgtgggtttgtcgtagatggctcttattattttgaggtatgttccttcaatacctagtctattgagagtttttaacatgaagcaatgttgaattttgtgaaagccttttctgcatctattgagataatgtggtttttgtcttttgttttgtttatgcgatgaatcacatttatttttttgtgtctgttgaacaaactttgcattccaggggtgaagcctacttgatcgggtggagaagctcttacgatgtgctgctggattcagtttgctggtgttttgttaaggatttttgcgttgatgttcatcaaggatattggcctgaagtttttttgttgttgttgtatctccaccaggttttggaatcagaatgatgcttaccacatagaatgaggtagggaggagtccctcttcaatttttgaaatagtttcatcaggaatggtatcagctcttctttttatatctggtagtattcagctgtgaaaccttctggtcctgggctgtttttggttggtaggccattaattactgatttaattcagagctcattattggtctattcagggattcaacttcttcctggttcagtcttgggaggatgtatatgtccaggaatttattcatttcttctagattttctagtttatgtgcatagaggtattcataatattttctgatggttgtttgtatttctctggggtcagtggtaatatatttgctttttcatttctgattgtatttatttggatcctctctcttttcttctttattagtctagctagtggtagaggtattttattaattttctcaaaaaatgcctcctgtattcattgatattttaaatggcttttcatgtgtcagtcttcttcagttcagctctaatttcggttatttcttgtcttctgctagctctgggattggtttgctcttggtttcctactttttgttgtggtgttgggttgttaacttgagatctttctttatgatatggactttaagagctctaaatctatcttaacactgctttagctgtgtcccagagattcttgcatgttgtatgtttgttctcattgttttaaaaaacttgatttctatcttaatttcattatttaaccgaaagccattcagagcaggttattcaatgtaaatgtacttgtatggttttgagtgaatttctttgttttgatttctaatttcattgtgctatggtcagaaagattgtttattgtggtttcagttcttttgcatttgctgaaaagtgttttacttacaattatgtgattgattttagagtaagtaccatgtgacaatgagaagaatatatattctgttgttttggggtagagaattctgtagatgtttatcagttccatttggtacagtgctgagttcaagtcctgaataactttttgaattttctacctcaataatctatctaatattgtcaatggggtgttaaaatctcttactattattgtgtgggagtctaagtctcttctaaggtgttcaagaactttctttatgaatctgcgtgcttctgcattgagtgtatatatatttaggatacttaggtcttgttgaattcaaccctttaccattatgtaatgcccttctttgtcttttttcatctttgttggtttaaaatctgttttgtctaaaacaaggattgaaatcattactttttttgtttgtttttcattggcttgttggattattctgtgtccctttattttgaacctatgcatgtcctgcttctataattactaactgtgggaccttgggtaagatggttgccctttcttaacctcgcactcctcatctgttaactggaggtaataatagagcctacctcactgggttttcgcccctgaggattacatgagataatgtagcatctagactattacgaggaaggtggaaagaactgttttcaagttgtttcccataggtgggataaattttacttattttgaaaacttttccaatgactgtgtaaacaacatggcgtttccccagcataaatcctgatcaaagactaaagtacttgctaaaccaggttattagcagataatagtcagtgtcagagtaagtggctaagaaaacaagacttcaaaacctgaagacctagatttgaatccttggttttcatcgtattagctgtgggattttgagacggcacttaaagtctctgggcctgttttatcttttttttaaaaggatacactattcgtttctgccttgaaagttgttataaagactgaataaatccgcatgaagcacttagtgcaatatgtggcatgttgtaggcaatctcaagtgtttgctatgactagatttattcataatgttattgttaaacatatctagaagccattacaaactatagcctgtaggccaaactctacttgcctcctttttttttaagtagtttcctactggaacacagtcacacttactcatttacaaattatttgtcttttcaaatttttttatttgaaatacaattgtacgtatttatgaggtatatagtgatgttttgatacatatagcatgcagtgagcaaatcagggtaattagcatatccatcatcttgaacattgattatttcttagtgttgggagcattgagtatcctttttctagttatctgaaactgtataatatattagtgttaactctggccatcctacagtgctaaaagttggctgcttttgtgttacaagtagccacagagttcacatggtcccccgagcctaatactttcactatctggcccttcacagaaaaactttgctgacttgctatgaacaagacattgtgccaaatttattctccacaccatgaataatattttttcagtaacacacgatagatactgttgttatccttattttttatatgaggaaacaaagactcagatttaccacttaaaatgtccaaagtcctacaactaacaaatgacacagctggaatttgaagcacttttatatgacactacagttcacaatcgtaatcatatcacattttttagattaggttagattgttctctggtgatgtgtagtgactgaggtggttacgagtttttttttgtttgtttttttagttgtctctagtatcctatgtagatagcatggagagcacatatttgaaaagtccacatttgggtcaatcatttccattttacaagtgttaagaactcatctagggtgctatgcacatgatctagcctgacaatcctggaggagactggcctagctacagataggtttttctactaccatcttttttgacaactatccttcccttccctggagagaactgtttgccttcaccaagaatgctggctccagaaggccagctgtgtagctgatgaattagttttgtagactattgctttcttttctgttggcctcttgggtgtctgctctgtagctagtaggtgtgaagcttatagaaacgtgtgtagctgcagctttgcctgccagaagcttattttgtttgagacaataccatttccctttgattcatttttgaaatatattatatgcataagaattaggtcctaggaacaatttcccatgagatcaatttgcaagactctttagtttagaaagaaagatcattctcttgtgtgtattggtttgatatggaaatacatatacttgccctacatctagattgctagtgtgctcagaattttctttataaagttcaaaattaaatccatacactctgtgcctaattttatttttttttttggtgtctgcatgcagacactttcttaaggatggagcccttaagcacaagaagagtgtgatggaacaaatctcaaatctacagcttcaaaaatctgtctttgttgttggctgaaagcaggactaaaagttctggtgactataaatccagacattgtactttcagtgataattaggtttctcacagatctgacattctctatgctagactctaaatggcagtctatagctcagtttgcaaaagggggctattttaagacactaaggaagagattattggagttctccagttacacataagcctctccttaaggtcattgattaaacgtaatgttcgtggagcctagggtatttatttattttttacattaaatagtgccactcaggcgatttttattcatgctattctgtgccatggaaatgttgtatctcaacagaggattgtggtatgagtttactccatgttcaaccttcaacaagcatttactagtaaataactctgagccagacattatgatgggtgctggggaaataaaggcatgatgatgtattagattgatttattttcccagattttctgtttcctttagtgagtcgtttttctgctttcactcaggacataatttgaaaggcaattctctgctgtagtcaaagattccccatatgaggtccatcagtagtacatgtaggctctaacagggatacaaaaaactgtttttcccccttcatggtggaggaactcatggttactttctgagaccacagccttggaaggttatttataatatgcatttcattcagctctaggtttttatgaaaaacaattattattgtgtttaacaaaagtatctaaaccatttctgactatatcattaaaactaattcctgagattcaaagtggaacttccctgttccactaaaataactcatgttacttcatgaatgaatgttaagccttaattccataataggcatattatatatagtttgaaaaggcatattcagtatttcaatatgtcatttttagaaaccacgtaaaattcctcttgttttaactaacattagaaaaattagggtcagagaaatcgtggcggctggagatatgaagaaaaataacaatttttaccagagagttttaggggacatggcattgagtgaacacgttagtatcactagatgtgaactatatgtttataaaaaggtagtatagatctaaagaaaaaagattgcattcattaaattttatttgctttaggtaacaaacttttatgaataaagctccaaagcacattagcaaatttagtaactatattacacagaggcctcaatgtgcattcactgtgaatttagacctttctatttttttaaacattattgctctaagcctattttcatctatatttttgcattttttctctaatatatcatagctaacgtttgtctctgtaattttccatttttgctgtattcagctcattttgccacctatgacgttttttttatctaaccaccagcatcctttttatttgcttttcccaaccaattcccacatctacagagttagatggagtgctaacaggatctttgttttgtcatacgctttcggcctatattccaaaactctgaaactgacaactctactgaaatgaatcattcttaaaaaagacattctactttttaaataatttatggccatctgatttttttttaatgtaaacttcagggtcagaagggaccttttggatggtgtttttaaaccttaataattagccaacatttctatcataatagaatagagatctccatgtgattagccattaatacttcagctttactttgaaatctgtttcttacaagattaagttgtaattttcacttaatttatactttttgagtgaactttttgttttacaatgaaagtaagaaaagtatctctgaccctgggttaaaggtcacattactatttaattaaaataaaactgtgggtttgctaagcagtacatggtccacgtttataaggagagttctgtatttttgaagttcatccatgtaggttgatattttgggaaacatgcctagacagtctttattctgcctcgggggactttgtatgtgtaaaaccatgacatgcttggccttgatttacaaatgatcgcatgtcaacttaaatataatatgtatttgacagggctttctaggctcacattttttaccagaggaaacactggccatacacaaaaagctttcatcaacctggcctctttgtgactaaaaatattgtattcatttcttatattatctttaataactgtcccattttttctattatgaataaggcatttaatatctttgtatgcataactttgtaaacttttgcaagaatatcaatagaagagattttaagaattgatattactgggtcaaagggtatgtccattgaaatattagtaaatactgccaaattatattcttttaaaaagtatctattggttgattcccgggcaagatggccaaataggaacagctccggtctgcagttcccagcaacaacagcagagaaggcgggtgatttctgcatttctaactgaggtacctggctgatctcattgggactggttagacagtgggcgcaacccacagagggtgagcagaagctgggtggggtgttaccccacccaggaagtgtaagaggttgagaaactccctcccctagccgagggaagcaatgagggactgtgctgtgcgggatggtgctatccggcccagatactacgcttttcccaaagtctttgcaacccacagaccagatttgcttgggtgcctacaccaccagggccctgggtttcaagcacaaaattgggcagccatatgggcagacactgagctagctgcaggactttttcttgtaccccagtggtgcctggaatgccagtgacaaccgttcactcccctggaaaggggggtgaagcaaggaaggtgagtggtcttgctcagcagaccctacccccatggaactcaacaagctaaggtccactggcttgaaattctcacggccagcacagcagtctgaagtcaacctgggatgctcaagcttggtgggggaaggggcgtccgccattactgaggcttgagtacagggttttcccctcacagtgtaaacaaagcctctgggaagttcagactgggcagagctcaccacagaaccacaaagctactgtagccagactgcctctctagatccctcatctctgggcagggcatctctgaaagaaagggagaaaccccagtcagggacttatatataaaactcccatctccctgggacagagcacctatgggaaggggcagctgtggggacagcttaagcagacttaaacattcctgcctgccagctcagaagagagcagcagatctctcagcacagcacttgagctctgctaagggacagactgcctcttcaagtgggttcctgacccccatgccttctgatggggagacacctcccagcaggggttgacaggtgccttatacaggagaggcagcgggcatctggcaggtggccctgtgggacaaagcttccagaagaaggagcaggcagcaatctttgctgttttgcaacctctgctggtgatactcaggcaaacagggtctggagtagacctccagcaaactccagcagatctgcagaagagggatctgactgactgttagaagaaaaactagcaaacagaaagcaataccatcaacatcgcaaaaaggatggccatgcagaaactgcatctgaaggtcaccaaaatcaaagaccaaatgtcagtaaatccacgaagaaggggaaaaagcagcacaaaaaggctgaaaattccaaaacccagaacacctcttttcttccaaaggatcacaactcctggccagcaagggaacaaaactggactgagaatgagtttgatgaattgacggaagtaggcttcagaaggtgggtaataacaaaaatcctctgagctaaaggaacatgttgtaacccaatgcaaggaagctaagaaccttgataaaaggttacaggaactgctaactagaataaccagtttagagaagaacataaatgacctgatggagctgaaaaacacagcgtgagaactttgtgaagcatatacaagtgtcaatagccaaatcaatcaagtagaagaaaggatattagagactgaagatcaacttaatgaaataaagcatgaagacaagattagagaaaaaagagaatgaaaaggaatgaacaaagcctccaagaaacatgggactatgtgaaaagaccagacctatgtttggtgtacctgaaagtgacagggagaatggaaccaagttggaaaatactcttcaggatattatccaggagaacttccccaacctagcaagacaggccaacattcaaattcaggaaatgcagagaacaccacaaagataatcctcaagaagagcaaccgtaagacacataatcgtcagattcaccatggttgaaatgaaggaaaaaatgttaaggacagccagagagaaaggtcgggttacccacaaagggaagcccaccagactaacagtggatctctctgcagaaaccctataagccagaagagagtggggtccaatattcaacattcttgaagaaaataattttcaactcagaatttcatatccagccaaactaagctttataagtgaaggagaagtaaaatcctttacagacaagcaaatgctgagggattttgtcaccaccaggcctgccataccagagctcctgaggaagcactaaacatggaaaggaaaaatcagtaccagccactgcaaaagcatatcaaaatgtaaagaccatcaacactatgaagaaactgcatcaactaatgggcaaaataaccagctggaatcataatgacaggaccaaattcacacataacaatactaaccttaaatgtaaatgggttaaatgccccaattaaaagacacagactggcaaattggataaagagtcaacacccatcagtgtgctgtattcaggagtccgatctcatgtgcaaagacacacataggctcaaaataaagggagggaggaatatttaggaaagcaaaaaaaaaaaaaaaaaaaagtagggattgcaatcctagtctctgataaagcagaatttcaaccaacaaagatcaaaaaagacaaagaaggatattacataatggtaaaggattaatgcaacaagaagagctaactatcctaaataaatacgcatccaatacaggagcacccagattcataaagcaagtccttagagacctacaaaaagacttagactcccacacaataatagagggagactttagtaccccactgtcaatatcagacagatcaatgagacagaaaattaacaaggatattcaggacttgaactcagctctggaccaagcagaactaatagacatctgcagaaccctccatctcaaatcaacagaatatacgttcttctcagcaccgtatcgcacttattctaaaactggccacatacttggaaataaaacactcctcagcaaatgcaaaaaaacggaaatcagaacagtctctcagaccacagtgcaatcgaattagaactcacgattaagaaactcactcacaaccactcaactacatggaaactgaacaacctgctcctgaatgattgctaagtaaataacaaaatgaggcagaaataaataagttctttgaaaccagtgaacacaaagacacaacgtaccagaatctctgggacacagctaaagcagtgtttagagggaaatttatagcgctaaatgtccacatgagaaagtgggaaagatctaaaatcaacaccctaacgtcacaattaaaagaactagagaagcaagagcaaacaaattcacaagctgtcagaagacaaaaaataactaagatcagaacagaactgaaggagatagagagatgaaaaatcctccaaaaaatcaatgagtccaggagctggtttttgaaaatattaacaaaatagaccactagccagactaataagaacagagagaagaatcaagtagacacacacacagagaaaaaaaagataaagggaatatcaccaccgatcccacagaaatacaaactatcatcagagaatactataaacaactgtacacaaataaactggaaaatctagaagaaatggataaattcctggacacatacaccctcccaagactaaatcaggaagaagtcaaatccctgaatagaccaatagcaagttctcaaataaaggcagtaattaatagcctaccaatggaaaaaaaaaaaaagccaggattagatggattcatagccaaattctaccagactttcaaagagaagctggtaccattccttcaaaaactatttcaaacaacagaaaaagaggcactcctccctaagttattttatgaggcaagcatcatcctgatagaaaaacctggcagagacacaatgaaaaaaagaaaatttcagggcaatatccctgttgaacatcaatgcaaaaatcctctataatatactgacagaccgaatccatcagcacattaagaagcttatccagcacaatcaagtcagcttcatcccgaggatgcaaagctgattcaacatatgcaaatcaataaatataatccatcacagaaacagaatcaatgacaaaaattacgtgattatctcaatagatgcaaaaaaggcctttgataaaattcaacaccccttcatgctaaaaacactcaataaactaggtattgatggaatgtatctcaaaataataagagctatttatgacaaaaccacagccaatatcatacagaaagggcaaaagctggaagcattccctttgaaaactggcacaagacaaggatgccctctctcaccactcctattcaacatagtattggaagttctagccagggcaatcagtcaagagaaagaaatatgcatttagaaaaccacatcgtctcaatccaaaaactccttaagccaataagcaacttcagcaaagtctcaggatacaaaatcaatgtggaaaaatcacaagcattcctgtacaccaataatagacaaacagagccaaatcatgagtaaactcccattcacaattgctgcaaagagaataaaatacctaggaatacaacttacaaggtgtgtgaaagacttcttcagggagaactacaaaccactgctcaaggaaataagagaggacacaaacaaatggaaaaacattccatgctcatggataggaagaatcaatatcgtgaaaatggccatgctccccaaagtaatttatagattcaatgctatcccaatcaaactaccattgactttcttcacagaataagaaaaaaaactactttaaatttcatatggaaccaaaaaggagcccatacaaccaaggcaatcctaagcaaaaagaacaaaattggaggcatcatgctacctgacttcaaaccatactgcaagactacagtaaccaaaacagcatggtactggtaccaaaacagatatatagaccagtggaacagaacagaggcctcacaaataacactatgcatctacaagtacctgatcttccacaaacaaaaacaagcaatggggaaaggattccccatttaataaatggtgttgggaaaactggctagccatatgcagaaaactgaaactgaacctcttccttacactttatacaaaaaataactcaaggtagattaaagatttagatgtaagtcctaaaaccataaaaactctagaagaaaacctaggcaaataccattcaggatataggcactggcaaagacttcatgactaaacaccaaaagcaattgcaacaaaagccacaattgacaaatgggatctaattaaatcaaagagctctgcccatcagaagaaactatcatctgagtgaacaggcaacctaccgaatgggagaaaatttttgcaatatattcatctgacaaagggctaatatccagaaactacaaggaacttaaatttgcaagaagaaagctaacaaccccatcaaaaatggccaaaggatataaacaaacacttttcaaaagaagacatttatgcggccaacaaacatatgaaaaaaaaactcatcactggtcgttagagaattgcatattaaaagcacaatgagataccatctcaaccagttagaatggcaattattaaaaagtcaggaaacaacaggtgctggagaggatgtggagaaataggaacgcttttacactgttggtgagagtgtaaattagttcaaccattgtgggaaatggtgtggccattcctcaaggatctagaactagaaataccatttgacccagcaatcccattactggctatatacccaaaggattataaatcattgcactataaagacacatacgtttactgcacatgcacacatacgtttactgcagtactgttcacaagagcaaacacttgctaacaacccaaatgtccatcaatgatagacaggataaagaaaatgtggcacatatacactatggaatactatgcagccataaaaaagaatgagtttatgtcctttgcagggacatggatgaagctggaaaccatcattctcagcaaactaacacaggaagagaaaaccaaacactgcatattctcactcataagtgagagttgaacaattagaacatatgggctcagggaggggaatatcacacactggggcctgttggaggatggtgggcaagggagggatactattaggagaaatacctaatgtagatgacaggttgatgggtgcagcaaaccaccatggcacatgtatacctatgtaacaaacttacatgtatcccagaacttaaagtataataataataataataataaaatatctactggcattctccccaattgtgtttgagagtgtctgtgtctgcataccttcaccaactttgatattagcattctttataatttttgccaaactgggggaaaatgtttgtagatttactttatatttccttattattttgtgaggacttttgattttggtcatttggtttttgtttattttagagtaaaaaccctgttgagatgagaattttataaatcagaattctagtgtttgcttcattttaagacaaattttaaaaattgaaatgtaatatatactgatataaacagacaagtcatgaatgaacagctcagtggatttccattaactgaactcacccatgataccataactcacatcaagagctagaatgttaccagcaatccagaagtatccctggtgtcccttctctgtctctactacctttcccaaggtagctactgtcccaacttctagcactacaggttactcttgtctttaaaaacaaaacaaaaaagaaccttttatttaaatggacttctatactatatcttctttggtgactggctgctttcattgactgtgttgcatgtagcagtagatggttccttctcattgctgtacactagtctactgcagtaacataccacaatttagttttgctattgataaacatcacagttactttcaatttgggactataatcaacaaaactgccatagacatttctgcatacttcttcaatggatgtatttgttattcttgggcatatgcctagtagaaggataatgtaaaatttatccatacataaagttatccaaaccttccataaaagtttaaacaattctattaaaatgctgctttcatcacgttattttacctgttaaaatcttttaagaactactcagtgtcctctgaatagaataagaacatttttaaatgaattttaaggtccactatgaatttacaactgattgtctttcaccctttcccttgctctcatcctcaatggcatcttccttcattttgaccccagcactccaatctccagccatacttagttgtttgccattttgtttggaggaaaaatcttagtattaaccatgaaagacttaaacaaaactatggaggaaaaaaaggagaaaggtgctgtttctctaagactgttctcgtgaggatcttccgttttctttcttttttttaaatttattgttttactttaagttccgagtacatgtacagaacatgtaggtttgttacataggtatgcatctgccatggtgggttgctgcacccatcaacccatcacctaggttttaagtcccgcatgcgttaggtatttgtcctaatgctgtccctccccttgccccctacccgccaacaggccccggtgtgtgatgttcccctttctgtgtccatgtgtcctcactgttcaacttccatttatgagtgagaacatgtggtgtttggttttctgttcctgtgttagtttgctgagaatgatggtttccagcttcatccatgtccctgcaaaggacataaactcattctttcttttacggctgactagtattccatggtttatatgtgccacattttctttatccagtctatcattgatggacatttgggttgtttgcaagtctttgctattgtgaacagtgacacaataaacacacgtgtgcatatgtctttataatagaatgagttataatcctttgagtgtatacccagtaatgggattgctgggtgaaatggtatttcttgttctagatccttgaagaattgccacactgtcttccacaatggttgaactaatttatactcccaccaacagcgtaaaagtgttcctatttctccacatcctctccagcatctgttgtttcctgatgataatttattttgctgtgcagaagctcttcagtttaattagatcaatttgtcaattttgtcttttgttacaattgcttttggtgttttagtcattaaatattttcccatgcctatgtcctgaatggtatcaatatcatgaaaatggccatactttccaaagtaatttacaaattcagtgttattcccatgaagctactattgactttcttcacagaactagaaaaagctactttaaatttcatatggaataaaaaaaagagcccgtatagccaagacaatcctaaacaaaaagaacaaagctggaggcatcacactacctgacttcaaactatgctacaaggctaaagtaaccaaaacagcatggtactggtaccaaaacaaatatatagaccaatggaaatgaacaaaggcatcagaaataataccatacatctacaactatctgatcttccacaaacctgacaaaaacaagcaatggggaaaggattccctatttaataaatggtgctgggaaaactggctagccatatgcagaaaactgaaactggaccccttccttacaccttaacaaaaattaactcaagatagattaaagacttaaatgtaaaacctaaaaccataaaaaccctagaaggatcttccattttcacaaatactgtctggagctagcatcccttcaaatgtctttcctgcattattgactgcagtagaagtggagtataaagcaactgggcctccccaattgcttcagatcccatgtcaatctcattaacctgaatatagtttactgtgaggaagaaaactttaaccttaggttgaaatttatgtattttttccctagctgttccttgatgttatttcattacgaacattaacttacgtaaatgtttcttcagggaactgaaacttcagtaactatattctgctcttcagattatcagtcataaaatgtctgctgtcaaattgacatctaatcaaagaagaatgttcattttcttgcagacttctcactgcagagtcactcattctttatttacaacttatctaaaggaataagtttatattctaaaaattgcattcttttaaataaagtagaaaaatttctctctcatttagtctaactgacttaacatccaaattactctttttccacacattgcttctacattgatcaaatgacaattaatcaatattttttggccataaaaatgttaagttctaatttacataactttagagttgaactagattattcatgacagtcaatataattaaaacatcaaaggtgataataactacgaagttttacaatccaagtccagctatactgagcagttcatattactccatttctttttcatgattatcttatgaagaaggtgtgcattttacaaagctcaaagagtttaagaaatgtatccattttacatggtttataagtagtagggttgggatttgaacccctgtttgagagattgctgagcccaggagatttcactgtagtattaatattttgccaattatttcatttctctgttatttgggatttctttacaacagaggctcaaccatccagttgactaagaatcagttcaattgactgtttaactatcaattgctaggaatcaatgatggtgagttatttggacttcaccttcagtagaagtctcagaaaatctgtatctaattgattccctttcccaattgctctcagtaaatttaaagatattcaacaattcttgcaggaccataattcatgttagcctaataaaattccaataatttcataataatggatatatattaataataatagtaataaaaacgactacccactttgagtggttactgtgttctaggcactgtgctaaatgctttatgcacatttttattattcagtcctcatatctactcaatgaggtacatagttggaacactaaaacttaattctaaatgaagcaaataaaaggaggaccatctattgacatgcagaaacaaaaattacagaggtagagctgtcagcattggatctagtgctcaaaggtgtcacaagggctgggttcatctataccgcctctctgcactggtctccatgtcagctcaatctcgactcacacaggatctctccaaaggtgagctcacattttaaagttcaacagaaataaagctgctttttacccaatgtttccacacagcccaggtccagtctgacttaaccagcttggatgacaagcctatccttaaaccattcactgtggctgggaaaagactacgctgtttggccaggtcacaatcccactcctggagctgttgttcatttgcactgcatcgactgaaaatggggtaggggtggtcactctacaaaggaaaccaggtgtgctgttaccaaaagagggaatgagacataggcaagcaggaacagtggatttcatctacatatagtaatagtcatcattattcacattttacagataagtaaattaaggttcaagaagtttcatttgttgagattcaccagttataaaatacaatgacagtattccagccaatgacactcagagtaattacaaaactatagtgcattcctagcaactaagtctatacatacaatgaagattctcaagagagctttattgcttatgctgcttattccagccctgataaggaaccatcagcatttgaaccccagtaatcctcccaactataaggagaacagagtcatattcaggctgagtgaagtagaaactgctaaattctattcctctctaaacaatcagattctttaagagacaaatctgtttttatatttgtataaatcttatatatactgttgattcatagaagatgttattggtaatgactcaactatcaaacttagtggacatttatacatggaaattacctaattaattcctaactacacacttgaggggaaaatacactaggtggaaacaagaaaacagacaagagaagtagtgactatgtcgggaatgtgcaatcttcctagatggcctcagcggactttcatttttataccattgacgagaactgtgtcaggtgttcatccacagctgtgaataggacagaaaaatatttttgaatgtgtgggcaaattactgttctagccatatagaaaaaggagagaatgaatattgtgttggcaacagcaatttccacagccaggcgttgtgctggacacttgggataagccgatcagtgaaagcaggcgtgaccaccaactcgtggagttttcacttcttggtagaggcagacaatgtatttcacaaacacatataaaattgcagttgtgaatgtgctgaagtggaggaagtcatgagtccaggatgataaagggggaagtgtcacagacccaatcaggaggttaaggagggcttccttgaggaggtgacactggagctagggtggtgtctcagtcaactttagcatttacagagttcttcttgtaacaaatccagaagtaaagagataactaaagagaattttcctgatactttgaatacacttgtacctcatggctctttgtattgtgaatcgcagaaaatctcattcaaactcaatcaagagaaaaacgcattgactggctaaagttcagcgccctgcttcaggcacagtggcatcaaataatactaacatagtgtcaggaggtgctccacctctctactcagtgtccctctgggttgactccattctcctacaggcttttccatcatggtgtttagatagtggcaatctccagacttgcgtcttttcgtcagtaacacttagaggaaaacaatctactacttccccaagaataaatgttctgcatttggatctctttgtgtgtagcttggaccaggtaccagcccttgttaacaaccacttggtcactagagatgtcattatcttcattaccagtcttcagtcttgtgccctctcttggagcagggggtgaaatcagcacctcccaaactccatgaactgaaaatggggaagagaggccactggcttccctagaagaaagaaaacgcagtcttcagtaaaagtaggactgtttgctgggcaggcagaaagaacaggtgtctgctacagagtagaaataactaataacattaataactgctacagctagcaatagcaataatactaagaacaaacacttattttaaaagtgtttcttattataatttccccataaaaactcattctacattcttggcatgtcaagaatttagccagcctgctttgccatagctacataacccagaagacaaaactagctctgcagtttgaaattagtgagcatgagatttccagagaggaggatttccggtataactaattcccttccctccaccccgaagctcaccttgaatgcaccggtgctcattgattcatgcaaacttgtctctgttattgctgacatgcctggagagggtctgttaagggaagctcatttcaagcacagatggtcccaggtagcttagcctctgcctggtggccagactaagttaattcggacggccttagacttctgatcacatccgtgcagccagagaggaaaagaaaaacttatttatcatcttgataaacagtctctttcaatgtctgtggatgctgtatgtaactcggtagagtcaaatactattaaattgtcatcactgtcaaaagggggagtaataaatttttctacctgagtcatagttaatgacatctacaatgtgcaacacaaatcagaattactgtttgccttcttttctcctaaatgtgtgttttctgatctctctggctgtagatgtgaggcacagccctcaaaatataaataaatatatacttttgttattacctctcagctaaaccaataaaatatccagctgacaagggccagactcttggcttggatgaggtatgcatgcacaggcaaaagctaagcagaagtacctcgttctagttctgcacggaagacatggatttgaaagactgtatttcactgagtgaaggccttggaaatggctccacccaatagttatttgtaaacatatttgcagaagctgcttaaatactgttaagggtgggaggcatctcttttgctgtcatcatcttaaagaataatacagtcatctgtcccataacaatgtttcagttaacgacagacctataagataacatggtataataccatatttttactgtaccttttctatgtctagatagatttagatacacaagtacttattatgttatagctgcctacagtatgcagtacaatagcatgctgtactggtttgtagcctagaagtaataggctatactatctagcctaggtgtgtagtaggctataccatctaggtttgtgtaagtgtcctctatgaattagcacaatgatgaaatcacttaatgacatattcattagaagttaccttgtcattaagtgaggcatgactgtgtagtagactgtatagtacgctttgttaagcttcagcaacaacctccaaatctcatgggcttcaaacagcaaaagtttattgcttgatcatacaacaagccccttgtgatttatcagtgtggctgtgtttgcaggagttactcagggactagatcttctggagcaggcaccgtctaaaacgggttggcaaactggcctgtaggccaaatctggtgcactgtccgatttttatgatccacaagctaaaaatgatcttcacctttgaaatggctggaaattgtgacacataaaaatcacacaaattcaagtttcaatttccataaatattattgacatacagctacactaacttgtttatgtatcatttgaggttgcatttgtgatataacagcgaagtttggtagttgctccagagaccacatggcccacaaagctgaaaatgtttattatctggatgtttatggaaaaagtttgttgatccttgatctgaaataccactggctgccacaccagcaggaagagagccctggaaggtcttgcacaggcaattaaaagcttggcttggtagtgatatgtcaagtctgttaatacccagttgactaaaaacagtcaatgcctcctcctcccacaaggggatcagtaactaccataagcccaggaagagaagacagtcattggcatccctaatggctgctccagctaatactaataatagcaacagcatcagagcaaacacattgctcctgtactcccacactcttccaagtgctttccctgtgtttactcattcatcctcacaacaacctcatgatgaaagtattatagtactattttccccattttacagatgaggagactaagaaaagaaagcttgtatgattttcctgagataaatccagctaataaagggtggaagcagttgaaacccagtcaatgaccccaaaattcaatctcaaacactgtgctctcaaccatcctaccaatcacagacctgctgagatttaaaagaatgccattcattgatgctgtagagacaacttcttcacaaaatcctcaattatggaatatgctagacataagcaaaacactaatttagtgtctgtataacagatttctaaaacatttaacagtttatttaggaggtggttagtaagtggtccatagatgaaagtaaaatctaacatctatggagttgtgggcagttctcctataggaccaaaaaaaagagaaagggctgggtgtggtggctcacgcctataatctcagcactttgggaggccgaagtgggcagatcatgaggtcaggagttcaagacagcctggccaacatagtgaaatcccgtctctactaaaaacagaaaaattagccaggcgtggtggcaggtgcctgtaatcccagctacttgggaggctgaggaaggagggtcgcttgaacccaggaggcagagtttgcagtgagctgagattgtgccactgcactccagcccaggtgacaatgcgagactctgcttcaaaaagaaaaaaaaaaaaaaaggatggctggatttgcagtttgagatcagtttatggctcagcaagaggaccaactgacgggcatctggccctaaagtggacagtattttacagccacttcttccttgagtatctcagattttgttttgatcttttcatcttcacttctaagccaactcaaaaatgttgttccattttttccattggaaaaaaattccaatggcattttcttcatttagctggagaaaagaaatatcataaaatagttatggtttagaagtgatggattcagagtcatcatattgcagtgtctgcttttttgttgttgactgtacctttatatcttcataaaggagtttgtttgtaatcaccacccatgttcgttttaacatccattacacttatctgtgaacaataatggaagaatctcattttaagagaataaaaagaagttaatgattattgttgggcttctttctcagtatgtattcctgcttgtatatcattaaataaatgttataaagaaacatagaacaaaaatgaataaagaggtaggagtagacaagtcaggccaggcacagtggctcaaagctgtaattccagcactttgggaggctgaggtgggaggatcacatgagaatgggaggattgcttgaacctaggagatcgagaccagcgtggtttgtaacctaggagtaataaatagggagtacaaagggagacgcccatctctacaaaaatacaaatcaaaacattagccaagcatagtggcatgttcttgcagttccagctacatgggaggctgaggtgggaggatcagttgagcctgggaggccaaggctgtagtgagctgtgatcatgctactgcactccaacctaggcaatggagtgagactctatctcaaaaaaaaaaaaaaaaaaaaaaaaaaaaaaaaaaaaaaaaagactagacaaagtgagtatgcaatggaaagaacacgttaggccccccaccactgcaggaagagctcagaaatttggggtctttgcaacctggaacctaaaaggcaaatgactccattttccagcatttcagaattctaccctttcatcctcctccagtgttgcctttgaaattgggtttcaatttttatattaataacaaggagaatggcagcccttatttatagtatacctactatgtgctgctcgatttattaattacttttcatatacaatctctaatgcttacagtatccgttaaatttaggcattttgcttacagggacgagggcttagaggttacaacttgctccaaattcatccagctagtaaccaaagtgatgttaattattcaaaattatattagatattagtatattcaatcttttatgtcagtgttttatataattttagaaaaattagtatagccagaggagttattcatataaaatagcatggcctatgtctgttctggaaattgtttccatgtcattctcagccctaaaggatagcactggtgaaggaaagcctaatcaactattgcctagctggttcaatggtcttggtttaagaatagggtcaagggagatccaaaggggatttaagtcaagaatattgcaccctagaatgaacgtaaacatagctatttttctaagccttatttcatttcaattcttgtcctaatcacagtagaatacaacttattcattttagatgttggctcagggaagctgtgattcagtttccagagactaatattgacatccagggtgaatgccccactttgaggaagaaacttccccttcagttgtttcatttctgagattgcattaatttggaatgtattgaaggaaagtctacatcaagcaagcaaatttgaggacagagaatagaaaagtggagatatatcctcagccttattttaacaaaaatttgaaggcagatctaagagtagcccaaaggcagtctgatgtccaatccattacatgagttccctttcctcatgctctctgatgcatccttgttgggagagagtaaacgttccacaatatgtaaagagcagtaaggaatcaagtgtgttcttgtaacctcattggtgcacctttgggtgaaatgtatttccgtgggggtagaccagttgctaaaagttatttctgcagtagagtttcaacatatccaacgtataagccattttcttcttttaaaaattgaagaaatctagtgggtgggtgttgagttgattatggtattaccttacttttagcaattttatttcagggagataatgatgcctaaatgcagtttctccgtgattagcctggaatgagagtagaaaggtaagagtgaggagtagtccatactggtgaaaaaagggaaaaaaataagagttatatttttcccaccaataattctgacctggtcaaagatgataatttcaatagtattaggaatatcagagtaaattttcatgcctactctgaaccaggtattattataatcactttgcctgtatttatttaattcttatacctgataagtataagaattattgcaatccagggcattcaccctggatgtcagtgttagtctctggaaactgaatcacagcatgaatgcccttcagcttccctgagctaacaactaaaataaatacgttgtattctactgtgattaggacaagaattgaaatgaaataaggcttagaaaaatagctataatatgtctactgttcactataggatgcaatattcttgacctaaatcccctttggatatccctcaaccttactcttaaaccaagaccgttgacccagctaggcaataatgtagttcttaaaacaaccctgtaaagttgatgctgtcatccacattctacagatgagaatcttgaaatatagaatggaaaataataggaagcagcagacccaggacttgagtcttggcagcctggctctggaatctgtgatcctatccattatgttaccctgcctcaaacatggttgtcctgcccagaatttcttcctttttcctacttttttcctttacatacccgaggacgctgggagagaaaggatgggaatttgtttaatctcaagcataaacaaatcaagcagctattttgccctcctcaaccaaaacatgcttaaagatccattagtgtctctcttgtcaatgatttacagacaaagacactcagagcttctttccagtccattgggtcaataaagcatttttaacacagtattaaatatgcatttctgacatccactatgatgaattccaaaaaagctacttatacaaccctgatcaaaaagtcctgtaaaagtgactctgaaaaaaatttgcgatttttcttacatattacagcttttaaagaaaggaaccgtttgtaataaagtggaaatgcaaggattctaataatcatgtccatcttaactttctttaaatatggtttattcattttctccaaaagttgtctttggctataagcatatatcctggcctattaatgagaactggggtttactcatagttacttttaattgctatttcattttaaagctatttcacttagagtaaaaagctttacctttgtaagttatgactcgatccccaaccaaaatcccaagttgatttctctagaaggtatattggaagttctcatctttgcaaaagctacacttatcattcaaattcatctttgtgaacatatccacataatggatattcagaaaaggttcccgaaaaaggattaatttatacattctgtctttcttcttctaccgtttccttcctattttccttttctttccctttacattccacatattcttccctccctctctttctttccttccttccttcctttcattattcagtcatttaatcatttagtaaatgtgtgactgcccactattattccaggcacaagagataaagaattaaacaagatgtggtccccctgccagcgtggagtgcccagccaaacaggctagacaacaagcccataattccagttgggagtcaggctgaaaaagaaaagttcagcttgctaagagaacatataatgggggtcaaaagtgagtctttgaggaaaagtttcattcaacaactatttacataccaaacaagtgccagatttcaagcttagtactggaatagtggtaaaacagaaaaaaattgttgtccttcctccttataggaaaagcaagacattattttttaaaaatcaaaatcatgcacactataaatattattgtacaagaattatgtaggagatgtaggctcatacacagtagaatataactcacagtatggttcaggaaggccaccacagcaatacccacacacatgtacatgtacagggcttaggcttatattccctgtctttttatttttgaagcaattctctctattccaatttacactccccccttagcatattttcttctttcccggaaagtctgctgttgtgataatttaaagttgtttggctatgcttgttcttggacacgaaaccactgatagatatggtttggcactatgtccccacccaaatcacatctcgaattgtaatccccacatgtcaagagagggacctagttggaggtgattggatcatgagggtggtttcccccatgctgttctcatgatggtgggggagttcttataaaatctgatgattttaaaagtggtcatttcccctgcactctctctcctgccacatttttaagaaggtacttgctttctcttcacactctactatgattgtaagtttcctgaggcctcccaagtcatgcagaactgtgagtcagttaaacctcttttatttataaattacgcagtctctggtagtatctttatagcagtgtgaaaacagactaatacaatcaccaacagcaaaagatactactgaatgtccaattccctggcagatgaaaaggaccggacattagcaagttcccataggtgtccattcaaaaaatttgacccagtttgtagcccagagtgatccagttggttggtatgagctatttctattaaatatcagatctgggggcaaaccctgacttacaatgccagttgtcaagcttttagtcatctgcctgccagtcattcctaacctcttcttccctttccatcatgacacataattgtcaccagtggggacccttttaaaagaaacattatccttcgcaatttatcttccttatttcctcacttgtacagctcaagacagtgatgcattgagctgggaaggaggcatccattgctaggagcatattggacttggcatttttttaacttctccagctcagagttgctgctgccggaaataatcttgaaatgctatctttttctcttttttggatattagaaactttcttttcctgttaaaaataggtttgataatgtattcagggctctaacaaacccaagagaaaagagcagttgggaaactagagagatgccccatggagtttttttttgcaggggcccttccccttaacaccagggtcaacatgggcaaaaggaatgagaagaaagtccactgttttgaagatttgtggcagaaagagaactgggaagcagagtacatttaacacatctaacttttccagatcggtgtgcattagccagataattacggcatttacttcctagttggaaagaacaatgggatcccttataatgctagatttagggttttgggctaattttatagatattttagatgtatgttttctgcagattaactgataacagaaacaataatctggaaaatctgagtagtacaaacaacctccatactagcctgttctttattctatatcctctgccattagataataggttacttcatctgtcttgttttttagatctacagatcctgggtgaaatccaaaaaagagaccattttccataagcaaaaaaaaaaaaaaaaaaaaaaaaaaaaggaagctgcattttctaaggaagcacctaaatgacttagctttgagaaaccatagatcatcttgaaatcattttgacttggattgagatgaaatttagaaatggataggcattgacaccaaggaaaagtccgaaagatatttgcatgacaaatattatcattctgaaataacattggcagttaagtttgaaaggatagttcacaaggtaaaccttaaaatacaaatacattggattaaaatacacatttcctaatttccagaaaggttgtgacaaacttaactcttccctttcattgggagaaactctgggggaacattttggtttcctttctctttttccaagaagccagctgatggggacaatagataagtaaaacctttttgtctgagggagtcttgaaaaattttatctctgggttataataggaattgtatgtcattttatgtccttatagaatttgatcaccttctcactgtatcatgggtgggcccaagtaaaggtgggctcttgatgtagccaaaaagtaaaaaacacataggaatgtgggacggtgtgtattttacaagcatactatactctgtatatatactctgctataccaaaggcatacacccttcttggttaggttccatattatttgatcatgcaaaaatccatggcagatttgttattcatttttcactttgttcaatcatctacccatctaaatgtaatgtgatatctttgatgggaccctgaaacaggaaagtatattatgtaaaagctaaaagaatctgaataaagcctagcctttagttaataatgtgtcaatcaaatatttgtcatttaatactacctttagatagctgataatcacctaagtatgattgatttcactttttccttagcagaagaatctctgtgaagaatagatcattataccaaattttaaaaatagaatatctcctttcttagagtagaggtaactgagcccccttggataatccataaagtcccacaaaatgtgtctttagagcaaagttatgtaagtgtgacttttcctgccaaagatctaaaaattttacttttttaatacaagcccaggcttccatgggcaggatagactgaaagagtaaattgctccgtttgactgtctgctaggtctgttacaatgtaaactttgggaatgagatttgggtatgatgggacaatcagagcttccaactgttggggtcctgtggggttccactgtgtccaccaagacctatttctgggctctgcaccagtgtacctgagcagcatgtgtgattgaggccatagttcaacttgtcaaaatcaaagagcctgttatttagagcaacaccttcctggcctcatgtgtgtaaatccaccatctgtgagcctaaggaagatatggcctggggtcattgactttatatacaagtctttgatgaaaatggagcatttgtcatttctcagttaccatgctcttcctttttcaaagaaatgacagcatgtacgtcagggtgggacaggggaaagagcactgtatatggggtgagggtctgggttctggtctcaatgctgttggctccttgctaggtaaaacatgggcaagtttcttttttttttcttttgcattttaaatttggatatatattcttttattattattattatactttaagttctagggtatatgtgcacaacgtgcaggtttgttacatatgtatacatgtgccatgttggtgtgctgcacctgttagctcgtcatttacattaggtatatttcctaaggctatccctcccctcaacccccactccacaacaggccccagtgtgtgatgttccccaccctgtgtccaagtgttctcattgttcaattctcacctatgagtgagaacatgctgtgtttggttttatgtccttgtgatagtttgctcagaatgatggtttccagcttcatccatgtccctacaaaggacatgaatgcatccttttttatggctgcatagtattccatggtgtatatgtgccacattttcttaatccagtctatcattggtggacatttggcttggttccaagtctttgttattgtgaatagtgccgcaataaacatacgtgtgcatgtgtctttatagcagcatgatttatagtcctttgggtatatacccagtaaggggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtgtttttgatttgcatttctctgatggccagtgatgatgagcattttttcatgtgtctgttggctacataattgtcttcttttgagaagtgtctgttcatatcctttgcccactttttgatggggttgtttgatttttttcttgtaaatttgtttgagttcattgtagattctggatattagctttgtcagataggtagattgtaaaatttttctcccattctgtaggttgaaacatgggcaagtttctaagtcactcttggtctcatttgcttctcctgtaaaataaagatttgtgatgtgtttattatggtattgggcacataggaaaaactcaataaatgattactttctttaatattattactattaccattggttgcatggctatattgcttgctgtaagtctgtatcatctctagaaaatggaaataacaatagttctatctccatctttcaactactttgaaaattaaatgaaatatgtgttaaaagcacattttaaaccttgataataatatgtgagacattgttgaatacataaaacaataagaatccatgttctggaagagtttgatttccaatgggacacacagacaataatgtcatcagaaaattatatactgtgtttgaaagttacaggtgttgggggcaggggggtgaggggacataaagcaagggagctcatgagtgcttgctaaggggagtatgatttattttaagtagacaggtcaagtgtgcctctgattaagtgacatttgagcaatgatggagtgaggagtgggtgagccagagatctgttgggagcatgtctcaggtgatacagtgaccctcatggggtacatgcctggggtgctcatgcagtaaccgtcaaagtgaccagtgtccatggaggaaagtcaaggagagagagagtcataacaaatcggctgggcacggtggctcacaccagtaatcccagcactctgggaggccgagacgggtggatcacctgaggtcgggagttcgagaccatcctgaccaacatggagaaaccctgtctctactaacaatacaaaaaaattagctgggcatggtggtgcatgcctgtaatcccagctacttgggaggctgaggcaagagaatcacttgaacctgggaagcagaggttgcagtgaactgagatcgcgccattgcactccagcctaggcaacaggagcgaaacgccatatcaaaacaaacaaacaaacaaaacaaataaggtcagagtcacaactaggggaggaggggcggctcggatatttaaccttggtaacctttctaagccaagtgtcaaacattttcttggaagtttttcaaccataaggcacaaccacttgtgaaaagatgcaaaaagcctgagttttgggatctagtgactggggtcacacttatgtgattctgggcaagttatttaacccctctgagcctcagcttctcatgtgtaaagtggggacaataccttgtaaagttgctggaatgtgtataattaatacagcatccagcacccaaatcagagctccagaaatggcattgagctccaagagtagcagagaaccattcctttggctctttgacaacagtgccatgagggacaggctttggaccttcagtgcccaccttgttgtcagtattatttaactcagtgcagtaactcaggcgatctggcttgtctgtcattgtgtccgttgacttgactgtaaatcaaatgagattcaaaatacatcctgagagctttcatgtgccttgtgccattttcaatcataaatattgctccactcttgtattagagccaagaggtgactttaaaattagtggcatttttgtgaagtgtcgaactagctgttactgacttgacggagggtatttgtagctgacaattataagctaaagtgacatgattgcaggtgtctgagttaaagagtgtaatatatgattagccctattccattaacttgaatcccagtgtcgtgcatggggagatagtaaggcactcttccatgaacaagttgcagccttctttcttctagtcattgttttgcacgagccatttatttcttctccttcgctaccttgtacttctccaactcctcctgcatatagcttaccaaggtggttgccctagagaaatacctgtaccacaccagtcctttgttccaaaaattcccattcattgctgtgaggaaacaagtgacaaccttgaccccagtcaagcttacagtttggctggggcacagacatgaacaactaaacacaggaaatgtgtagggtgctaatagaatgaacaaaggtggacgtgaggagcattctctaaggaactgacctttgagttgagctctaaggagagttaactggcaaaatcatttgtgttggagtgaggaggttggagggatgggaggtaggagtgagtattccagaagaaaccatattttcaatccctctaagacagaaaatatgttatttatatctttgttggcaccaaagatataaatttatacctttgttggcacctacaaagatataaataatatctagtcactctggtattcttattataggaagtatatacagactctaccatatgtcaggctcggcactaacccctttacatgtgttctctctgtttatactcacacaaccctgtgatacaggtgttattattattcccattttacagatgaggaaactaaggcattcagtaaatgacagagccgagattcaaactaaaagaggctgatatgaaagcctgaactcttccctcctatggagagaaacataattagtctactcaaaatcagagactcttgcgtttctttcatgttaggccagggtttctcaacaccttcacaatatcgatcttttgagccagatcattctttctatgggaggccatcctgggcattgtgggatgtttaacatagccctgcttcctacctgaaagatgcaagtagctgtgtgctccaaccagtgatgacaatcagaaatatctccaaactggccagctattattatgggggagggagcaacatcacaccccaccaccactgcactgaggatctctgcattacacagttctcagaggacaggatgaaaggatgaagctgtgtcttaagtcttctctccttcctttctccctccttttctttttcacaatgttttctaagtgtccatatgtatcctctatgtacaggagatgtattctcatccatatagtttatcacacagtaatttgaatatagaggttgcttaacaaatgcttggtgaatttttgccaactgcatcctaaatgccaagaatcctaaatggtctgggtctattctgaactccaaatttgatgttgagaaagttgattcctggtttctggtcacttgatgtatcttttgcgtgtctctagagatctgacttagctgatttagctgatttctggggaaagacccacttggatgcttatcagcctttatgcagagccggcagttcacctgctaagatcgtagtggagagtgacatacattagtttgccaataaattctgatgaatgcatggatgagctgttacaattaagtcaagctatatgaccaggactgcaatttgagacattgtttaaagcacctacccattttctccagcaattctttctttcatttgcggatgaagtctagatttgggaaatatgtcccgaatagattttctatttagccccccttgagagtaggcaggcaatggaaggaagagctgatttctgggcagtttttctggcactgtagcttctgtatcactggagtgtcacttgtcaatagaactcagagaatcttaaatgtgatgataacacagaagatggctcccaaaatatgcatttaaatcaggcagcatctttattgggtgtgttagttgcaggcattcattgctttattgcctgtcaatacctacaggccagaattgccacatcttgagggctatccattggtattctttgctggtttggaagtacagcactgtcctctctgtgattacacgtagtagaagagagtcctgttgtaattgtatttcatggaaactgtttctataatttcaattactttcctcaaccccgctacatgcactcccaggggctcgaatagtcactgagttatttctaatcagtgtccctgttctttctctcttgccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatggtaggtacctggttttacctcttgaaaagctcacatggcattcactatacataatataatttcttgttttatctaatatggttccagataatgaacaaggtgcatccgaagtgttagaaagttatacaattgccagcctcagcagagtttgaattcttttttctctggtgctattatttgaatgttttttccccaaaaaatagatgttgaaatttgcttgccattgcagcattgagaggtgggacctttgagaggtgactgggctgtgagcaactgtattagtccattctcacactgctataaggaaaaacctgagactgggtaatttataaagaaaagaggcttaattggctcctggatgcacaggctgtacaggaagcatggctacggaggccccaggaaactttcaatcacaggagaaagtgaaggagaagcaagcaagtcttacatggccaggaaaggaggaagagagccaagggggaggtactacacaattttaaacaaccagatcttgtgagaactctctcactatcataagaacagcaagggggaagtctgcctccatgagccagtcacctctcaccaggcccctgttccaacactgggggttacaatttgacatttttttcaggtcaagaaacatgaaggtccagctcatttgggaaatgattttggactgaggctctagagaatgatgatggtgataatgataataaatattttcatgcgcatccgtgtgaagataccaccaaacaggctttgtgtgagcaataaagcttttaatcacctgggtgcaggtgggccgagtcccaaaagatagtcagcaaagggagataagggtggggccgttttataggatttgggtagaaaaaggaaaattacagtcaaaggggagttgttctctggtgggcagagtgggggtcgcaaggtgctcagtgggggagctttttgagccaggatgagccaggaaaaggactttcacaaggtaatgtcgtcacttaagggaaggaccggccattttcacttcttttgtggtggaatatcatcagttaaggcaaggaccggccatttacacttcttttgtggtggaatgtcatcagttaaggcggagcagggcatattcacttcttttgtgattcttcagttacttcaggccatctgggtgtgtacgtgcaagtcacaggggatgtgatggcttggcttgggctcgggctcagaggcctgacaaatataacaatacctaacattcattcaacacatatttaatgagcacttactgtattccagataccactctgggtgctccagaaaaactgatgaacaaacagaattgtcctgagtcctcagtatggatcaaaccctgtgctaaacacttctcatgcattattttatttaatcctcccaacaattctacaaagcagtatattttttctctattgtgatataacaaatcccaaaacttagcagcttaaaacagaaaacattatgtcacagtttctgtgtgtcacgaattaaacttacgaggttctggcttagagtatctcatgtggttgcagtcaagatctgaaggtttgactgatatggcagaatggttttaagatggcttgttcacatggctgttgggaggtggtcttgtttcctcgcctcgtgaacctctcaaaaaaaacttgatgtcctcacaacgtggtagctggcttccctcaaagtgagtaatccaataaaacaatacagaagcctttatatgtcacctcagaaagttactcttttttatttccacaatatcctacaggttatacccactagcccctattcattgtggtggtagaccgcaagggctggaagaccagcagtcagggatcattgtggggcaccatggaagctggttaccataaggagatacatttttatctaccattttcaacatgtagaaaccgaggcttggaagggttgaatagtgttccattcatcctatggttgataagccctggcttgaatgactcttcagcccagcataatggactctaataccaaatttagaccaccacctttaagacaattttatatgttactgtcaaacaatgagtccaaggcgcaaagggactataaatctctcctcccatctttatgtttcataatttagagctgggtgtaagttgattttcaaatcctttatttaagaaatcaggaggaggactcaaagaaatgagtcacttgcttggttcacataacaggacactgaacctgaatcccttggcttggtgttcattgttcttcctctagatatagataaggaaggacaacctctagatcgattcatgttatgtattttcattgtgggtcagtaggtggttagaaagagaaacacactcaagctaggctaagtaaagaggaagtattttaagaaaataaaggaatcgcggtgaaccaattaaaggaaattcagccaaacctcgtggaattcgtaaattcttcaggcagctgtcatctcattttctttgttcacggaacatactatctctgatctcgtttacctagttctctcctatgtagactgtctctcttcaagatttttatttttaccttctcataaattagagaatgatataaggcttttactttcatggtactgattctaatctctctcagcatgattgtattgcttcagggcatgaatatatttgactcagtttctgtgtcttaatacattatctgagaagaaaagatgtgattggcccagcttaggccagtgtgtcaacctttgcccagctagtcacagccagaggagcaagcttatgtggcatatacagctgtcaattatatgccatgggaaggtcaagctattttatttttattttttagagacaggatcttgctctgtcacccaggtggtgtgccatggcaccatcatagcttactgcagcctcaaactgccaggttcaagcaaccattctccctcaacctaatttttcttttattttccgtaaagatgaggtcgtgctacatagcctaggcttgtctcaaactcctgggctcaagcaaccctcctgcccaggcctaccaaggtgctaggattacaggcatgagccaccacacctggccaggtcaaactgttttttaaaggatgttaaaaagtcaagtttggggatatactgggactagttctcaactggggcaatttctcccagggatcatttggtaatgtctggagatatttgggtctacccatttgtcacaacaagggagctgctactgatacctagtgggtagaggccatgaatcctattgaacatcctgcaatgcccaggacaacccctgcgcccccgaatccccacaacgaagaattctcgagctcaaaatgtcaatggtgctgaggttgaaaaactagcactatgattatttacttactctacactacagtcaacacagtgagcacctctaatgcagggaaggcaggcagttagatgagtaaagctatttccctctctcttaaagaagaaactcttggccctagaagccaataagcattataaaacaaaaccatgatggtttctcatgttctttgccaaagaaagccttgaagccgttaactataaatcttcattttgtttccagttcatttttatctctaatgatctagaaatagaattgcctttaggatttggatacaaaacacaaagtgcaatgcattgcttatgctgacagagggggaaatggtatctagccctaagatttgtaagaagttaagccacataacagtaatatttttatctcaggaaaactttgttcgactttgggaactctgaaccctttggtgtggttggttcaaacaaaagggctatcctttctgcattccaggcaaaagtcaataaagtattgagtgttctttattctcatgttgattatttatatttttggtaacattctactccaaaatccttcaatccattggcatgtatgggcaagtctattgtgttgctatgatcaaaattgttttggtggcctagatctctaaatgaaaattaaatataaagtgtgactataaattaaaatttcagtatagttattcacatcatggagtgagaaatttcatatacctggatggaatcgcagctgtacctattactgatagaatgacatttttgatagaatgacatttgctttctaacctcagcttcctcgtctttatttttgatagaatgacatttgcttcctaagctcagtttgctcatctgtaaaatagggattatagacatttctactttttaagattgtgctgatttttttaagatttaagaaaatcttctatataatgttttttgcacaatgtctgactcccttcagaggctcactaaatgataatatctgttttctatctcactagtaaatgtggataatgcttagagagaaactttttttatgagttttgtttcatattaattgaacacggtggaattttagccatcatcttttcttagaaatgcttccaactaattatcctggatattactaatactggtaagtcatcttcaggaatgcatgtttataataggaattttgaaaatttcagagatacatccatgcactaaaatcacccatgatatcattgcccagggactattactacattgtaagataacatattaatatatgtccttccagtcttaccccactactaaaaagcaaactcacattgtaggtattttattgaactaaaatgctgtagcaaagttttatggatggcttgtttcacttaatatatgatgaccatttcccaagtgaatacatattcttcaaaaacttattgttaatagctatatgggtttttcagaggtggatacaccaccatttatttaactatcctctccactttatggcatttacagagtttcttgcattcccaatctcagttccctaggaatagacaggcatcaacttctctgcgtgacagcagttgatagtttatacaccacgtttgtcctaaacatattctgtcttatgcagtgaatttcccatggtaagtgttccaattgctcttatttgccttcctctgaaatttcaggtcagttgccttttacagtgttttcaaaaacaagagaatagctatcattttaaaagaagcatatattggattgctttaaggttgagaatctgagagcagattatttaaaatggaacagaaaatgtggggtaaaaccttagcagcttattcaagagtataatatatatttggagaaaattttaagtggtgatcttttatttcaaaaatgatattctattttctaataattgaaaacaccaaattacacacttgccaaattaagttatgaagtagtcatttataaatacttataaaagcattatatccttgaacctgtgcctagcactattctgaaggaatgtaagtcattataccctaattagtaattaatctataacccaaaatggaagtggggagcatgctactcaatatctttagttgagaacaactaaaaatattacctacagcctttcattaatttccaagttcttctcggggactaaaagttaaaatcaaataaagattcataaacaagaggttgatgactcaaaacacacctatttatttgagaacaatttttccaagcaaatgatttaaaacaaacaaaaataaatttctggagggcttatgaagttacgttctatgattctgattaatctacaatggcatgaaaatagtatcgatctcaaagttgtaaaaataatggaacataattaataccagtaataataataaaaataatgtttaccattttttaaggctattatgtgctactgtcccaactactctaagtctatacacttatttaattctaactctaaccctataaggtatgtcctcccattatttccattttattcgccaggaaactgaggatcagcgaaatttggtgactgactcaaaaatcacatagccagtcatggcatagccagaaggtcagcctgggctgtcttcagggctcatcattcatcaagcataggcaaactcttaactgacatgaacacaagttatattccaagggcattcttataagatgcaaaatatctgggtgagagggaagtaaaaccaaccatgtggatacttacagaaacacccagttcattgggcaatacctgccccttttttttctacatcataaagatgattgcactttcattgttatggagcaattagaagcagttctttcagtgcttttatttttatagaatgattgaagcttcattgtttaaggcatagtgggagtggtaaaattttcgtgcagttttctctatttaggattttgttgtcttgtaatttttatctgtttctaacatggacaaatatggggggtggggggcatttaactagttgttagtaggggaggtcctttaatcccttgtggattttagcatcactgtaattaagaaaaaaatctctatgataagttcagaagtctttcttctcattccatgtaaattatgaccatttggatgactgattactagcaaccttcacctggtgttcttgccgtcttatactggatcaccagcaagagaaagtgttaacaaaaaggccaggttacatcagaaaactttctttcacggcagtgaaaacccaagtttaaaacaaaacaaaacaaacaaataaaaaaaccctttagttaatacaatgaaaaagtcatcctgctatttctgtgaagaaacaaaacttacaacgtaacagaacattttgctcctggctcatcatacttagtccccaagataagtgcaaatgagacagagaagacatacataaagacttcgacccaggaaaacagactgacagagaagatgagacagaccagacagtgagagaaagaaacatacaaagcatatgagaaagagagggtcagagattaagggtagtaaaagagagtagttaataaagaaatgcttagaaggaacattaatacatctatccataaaatggcttgattcattttccccaagaactgtttgtattcagtcttacagtttataactattttttaacaaaataaaatttgacagatgtaactttaatttttttttcaagtggcattatatgagattctagaacaagaacttctgcaaaaattccttctggtgattgctcctgggaaaaagtcatgatacaattttcttgaccacataccatcatatttcctagagacagccatggtagagaaaaaggtttgataattgaaggaagtttgaaattcagcaacagtttttcataggataacatgagatatatgtgagaaggattatgtatgatagcctctgcttagccttccaaaacatgacagtgtattaaaggctctgagaaattctgtagacaagtagcttattaaacttgaacacaatatttcccaaactttttagaacctttttaactgtaacatttatttgtctcctctagtccccagaattccatgcaatagacttggggccatgatgctgtagagtctgtggactatgatttgttttttaggaatgtctttcaagtcttccgagttaatggatagtgtgatgcccgaagatagctaagtgttgcctaagactggctggccagagagtacacaactgatcctatactgatgtgatttatagtatctcagtgacatgtcgggctcaactgcagcttggaaatcatctagagagcttccagagcaagcctagtatgaaaaaccctaagcccctatttatattcacaaatattaaacgtttttggggacagagaagatgacctattttggttctgccatttgttacttgtcatccacacacgatgaaatactgagataatgaattgctgtggtggatcagggatgcatgccacaaaggctggctgtggttccttcattactgtctctgtttgaaacttgctttgttctttttaaacacaccaaagcttgtttagtagatggaatgctgaacgcatttgactttatcagaagacatttataaagggaaattcgattgttcttattagaagaggatcttgcataacatctttagtgaagtgatggcattttcaggcatgctttctgaatcttatgcaaatcctccttgaaacagcatttagtccccaacttggcacctaagcatgtacaggtgtgtgagagatgcaagtctgcattcataagaggaatgagaggatgaatgtacaagaactgtcaaagctttttatactgcctaataaaagataggtgtctacgtttgttcctcctaataaagacagctggaattcagtcatcatatgtatctatctaatagcagatgttgtcatctttctgtttgtttgtttgttttctagtttagagcagcagttgccagtttccagcccactggcaaaaaccattctcagacctgttcctgaggtcagcagagtattgaaaaaattgactttgcatgcctttaaatgggacactccagtttcccacaaggctcactctttcttattattgcactaggctctgacaggttgatgttcctgcctggtccttaaaggcaatggaatatgtggtaacaagctcatacagtcgtttcctactaatttcaagtgaataaactaattttgaatgaattattttttctaaaaaattaattttgtagaaaaaatatactctttaatcaaagtaatatatataatctgttgtgaatataaaagtatgcatatattccataatagaaatatacatcaaaacatcacattgtaccccgtaattatttatcaattaaaaatttttacaaaagaaatgtatctgtataaacctaacaaagaaaggataaaaattaaagtaattcttcatttttttctttctcactaatcctctcacatcataattgccagaggaaattatccttgtcatatttctacacatccttacagaaaaatatttgggtacatgcaggcctacaggtatagacatataaaactttataaataaaaatgatattatattgtacagactgctctgaacctaaattttttagcgcagggaaataagtagttcactgaaagaaataaaaatggctggtaaacatggaaaaaatgcttaccgtcactcacatgaagaaatgtaaattaaacactgaactacagtgtttcatcaatcaaataggcagagatgaaaagtttggtaatatccagacttaaggaagaaagacaaaaaaattacatttaaatcatactcggtgataaacggcttacaaactcaattagttagccactcttctctatggggttcaccaacaaagaagatgataaataggaaattttgtgatgagactggctgtttcgggtacataatacaaattatgtgcattataattgcaatgactttagcaacatctcttgaatgtttaattctctgcattttctcaacaggatcagattcatgactgtgggtatcatctaagaaatatttcaagaattttgatgttattttaatgtgaaaactatacataaaattagatttaatgcgtatacttggattaatgtagcaagtctcattgtaaagcccatctatatagccacttaagagaagcaaaattctctgtataaacatctgtcatgatgtgtatgtcatgtgtgtgagagagagagataggtcatggcacagcacacccaaaatccttgtcagttacctaactgccataaacttgtttacacataacctcaaattcacaaagaaatttccccaaagtagcccccaagtcattggttttcatttatctctagagagctcaggtgttttcaaagaactggtcttctctgatatgatagcacttttcatcctttctttttccagaaagtgggaaaaatgttgttctaaatctaaggagtcagctcctcatctctttagctgggcttcagcctagataaggcaggattctagggtcctgtgttattaatgtgctgtccacatgaataactagcaaatcttgtgaattatttcacacttctaggaaaatctataaccctgtccttctgcaacaacactggaagctgccaaggatactggtacattgctatgtggaaaaatctgataactttatataaggaagtagtaaaacttgtatccccttctgggacctgtatataaacttatacagatgagtaatattttaaaaaattaatgatatatatgttcctccatcctctgaagctccttgaatttttgaaaacctaccaccccccccatacaagttcaaacaacaagatatgaattacccattgataaagtttggctgtgtccccacccaaatctcatcttgaattatagctcccataatccccacatgtcatgggagggacccagttggaggtaactgaataatgggggcaggttttcccatgctgttcttgtgatagtgaataagtctcatgagatctgatggttttataaagggcaattcccctgcatatgttctcttgctgccaccatgtaatttgtgccattgctcctcttttgccttctgccaggattatgagccatcctcagccatgtgaaactatgagtccattatacctctttcatttatacattacccagtcttgggtatttctttataggactatgaaaatggactaatgcacccactaaccggagcagagatgcccaaacatgtggagtttaaattcaaaacctgttaaggtattcagatttaaaattgaagaatgagtattttcctgttacccatactgttgagagcagagggagaggaggaaggaaggaccacatgggtagcaggaatgtggcctactagagtaaaggccatctgtgactagtaccagagagatgtgactttatctaaagatccatatctccagcctccagccaagagaacactgtacttgacagctcactacactttgttccagccattttattagctgccttcaagtgaagaccatccattaacagcagctagatattgcacattgattttccaacaaaagtcataaacacaggcatccttcgacctccttagcctcctaccctgcataggtgacccccaggaaacgagaggagaaacctgggttcctagatgggtggagtagtcataggaaggaaatcttatgcaccaactctgtaagaacagatgggtttgagatcaccaactgacctaagacattggtggaacactctcaccctccccatttcacctgtttcgtttatgaaatgaaaagcaagtccaataatatctgatattacttggtattttcattattgcatcattttaataattgagggtaaaatttattggactatcaatttatattacttaggcttataaaatgattgggcaattaactagacactcattcaaaggaaggtcacatcctttaaatttagagtgacctgtacatgctaacttagaagtcgtcattcatggtctcctttggtgcctatgcactaattttgctttatgccagatgcctcttctcatcaatgtctcccgggtacaagaaacctaaacctttctcaatagaggttcaagtaaaaagggaagttattgtgagaatatacttggggtcatggaattcaagagcagagattgattgctctacagcatgccttgaggcacctgaaactgaaatactgatttcagcaggcagcccatttgtgttccccatagctctttctcatgggagatgttgcctttcatcttgggctcattctggatatttgccttgttctcttttctttacaaaccagggaggttaagtctgtccatgtcacctggcaatgatcttctcaactaaatggaacactacttagagtagtaggctaaaactggtaattttactggtttgtagttactgagttcttactgtgtgccagactctgtgtattgaatttattacttatatcatccttataatagccttataagataggtactattattcccactttacaagggaagaacctgatgccttagagaagttagatcattccttccaggacatggtagggatagacatgggaccccatgtgggaactgctggaaataatgggcagaagacaggatcagaagcaagggtaggaaagattcagagtaccagttcacttcttatatttgctctctaggagaacaataacaccagtcacactagcctcctgattaagctcttccttcaacatacacaccatcatcattcatgttccatatgtttacattccaaattcatccatttctcctcattcccgaatttcaagactgccattatctagactcatatctcaacacttgttaatccatctgattgaaatgcatcctcaaaaccccttcttcataccatctgactcttcattactcaacttagatcatcaattccagaggtccttcctgaagccgctatgcctaagttaataatgcccacctgtgagtccttggaacagcctgtataacatttctcataactcactgtaatgtactataatctttgttgacttgttatctcctttgctagagagacttactcactcattcattcattcagcaattatttttggagtattgactatgtgccaggaattatgccaaatacttaatcacataatgctgaacaaagacagccccttgctgtcatggaacctacagtccagcaggagagacagaccatgatctaatcatacctaaacatatacaagtaaaccacacattcagaaggaaaagaattctgtccttggagaggattcaataatgaggaatataaaggagattggggaactaagaagacttccgtgaagacgtgacaggaagcctgaaatgtgaggtacagctcaagctagtgggtgagcagcattgcaggcatagaagagagcatgcagaaaagccatgggttttaatcaaaaagttgagagaaagccatggtggtggaagcccataggacaatgaaattgcatgagacagaaggctgaaaagttagatacggccaaacaagaagtaacaataaatagtgtagtaattaagctgtgtgtctctattacgtaacatagttcttaaaactgagtcatgctaatcatgtacttagagggggcaataaaggaatctgcagtgggaaattgcgtaaattagtcaacttagaattttgtgagtgaggagacagtattgagagccctctatagagacaaacatctcctatgaagtgtctgacaacagatttcaaaacctctatactaacacttcagacaatgccaaagcaaagcaagtcaaattgtctttttgatactaccagcctccacacatgttgttacccacacagggttgctgtcacctgaatgtctcattcactctctactcccaaccgctcacactgctacaaagagtcttcacaactgcacacacacagcaaacaaacaaaacttttggatggaaattttaaatcactgttcttttcaattctgcttactgtctgaagcagtcttaagatactgtattaactaagagattctttatacaggggaagcgcatctgggtaaacggcttctcatttggggtttattttaactacaggctcatgtcaatttatttttctcctgattggcacttaagttattcaactctaatttatttctttatggattgacaacaccatgttgtatgtagctccctccctaaccccctacaaaagcctctataacacctataccaaaggacgcctgaccagccttccatgaaatctggggtagtatagtgttgtaaaaattcaaatgcaggtgttataagtctattttgtgaagaaagagatgatggagaaatggctgtttctcacattaccaagtcctgctccctttaaaatcttcaagcacataagtttgagaaacaatgtaataaaaccacattcacactatagaaattacctattgcccttagcagcccttatgcaagaattataacaactacagggactgagcgttgttgaggactgacactgtgtctcatatcctactgaaaatgttaccaacattatgatacctaatcttcataacaatgcatgagatgggtactattgttattatccccattttaatgataaggaaactggggctcaagatgataaggggcttgcccagggtcacatagctaccaggttggagagtcaagattcaacctcagcaatctgatagtattactcatgaaagatattaagattgcattcattctcaaacagacaaatggaaatttgttatgggaatatagaaacactgtgacttggaacacacagaggcttgaatttcaaccctaattctgccactgattagtcacgttgtagcaggatgagtcgcagacaaaactcctcagacaccaaattaaagaaggaagaagttttttatttggctgggagcgtcggcagactcacgtcttaagagccgagctccccgaaaaagaaattcctagcccttttaagggcttacaactctaaggggtccacgtgaaagggtcataatagatcaagtaagcgtgaggaacatgactgggggctacatacatcagctaacaaaacaaaaagttttacaatgctttctcatacaatgtctggaatttacaggtaacaccagtagttttggtcaggggttaatattattattattattttaaccaccagggccggatggtggtgccaaggtcatctagctatttatcttacctctgttgctttccaactttttgctttctcccttttctcctgtcttataaactagggaaaaggggaggttggggagaagctgggaaggacaacaggagaagtggtggtctcatttcataacgtgtccttaaacgtattaccctcttggaaccacagtctctttttctataaaaaggaaatgaaaagaatatagcatggaagagttgaagggaatattaaacaagaaaattcatataaaccacaaatgcgtaatccaatctccatgcatattgtgagccctcaattatattagcaataatgcactcagaaaatatattaaatttatattttcattaataagtgcatttctagagcttaagataagaaatcatgcaattttgattgtaatgcctttgcttgtgcaccttttcctcatttgattacctccaaccataaaacaagactttcaagtctccagaaatgtgtgcagagaaacaaaaagaagctggtcatgacatagaaaagtctgtatcccatcaggcatgataagaggagacaagttgaacgcgacatgccgtgttttcatgcagaagtgaaggtactgaggacatcttctaatcccagtccaagtaagagaagacactcattttccaagctcccattggtactcacagtacctctggaaatgaaatatctcatatgcatgatggaattaaggaactaggagtgtgcatttcactgaagatggggcacattaggtacaggttgacttacccctgactttggtcttctcttagccctcacacgagagctgcctttctcttctcactatagagactccctaggttacttcattcattctcatggcttcagagacccaaatagctcccaagtctatgcacctagcctaatccgttcttccaaactctaggtcattttgttcatgtagttattagacatctccgtttggatttctcaaagacacctcaaattcaatatgctgaaaatggagcacacatttccaccagtctgcttacttgagcatggtttcagcatcactcaatagcatttgcatttactctttattcaagccagcctcttgggaaacatctttgcctttcttcacttcctcatggcccatgtccattttgtcatcagaactccttagttcctctgactaattctctttcatcttttcccttctttccatctcaatttctatccaataaccaagctgaagccattatcaccttttcaccttgattactgaaggatcttcattcttattgcctgaagtctttatcatacacagcctccaaaaactaatctaagtcctcctgttgttggctactgtacatcttgttcttccctctttggaacacaaattcccactttaaattacattttaatactatctttatttctgtacaacaaatgctgcatgaaggcaaagttcatgaaggtcttgttcacagctgcatgccagtgcccagcacaatgactggtacagatgctcaaataattcatgtcttttgtacttatgtagtgggacaagatcaaatcaaagatggatttatgttccaattccagctctactataatcctaaatttaagttcccaaatctgaaaacaggaattacaagaacttaacttcacaatgtaatttgagaattatataagaaatgcatgtagagcacttagcacagaattagttctgaataagtattagttctaacaattgaaaggattgatgtgagatacagatttggtgggccatctcttgaacacttcactgttaaagtggagaaattaagacagcacaggaacaattcccagacttacacttgagcattgtttatgtgtaaaggacattcttttgtcctgagtgtatcacagactcaattgactatctctaccctaagttttctgtaaaaggatatcagagaaaagttgaagtcttgtacttggtggaaccagtcaaaaacctgatgtttttaatgttatagaggctacaataatctctatcaacaaaactgaattggcagtgaactcttctaagcatttgtatcgtctgaaatcaataaacttaagtttttatgttgttttacttttgagttgctagtgttatgtgaagtggtaacttgagattggtgtggactaagtttttgcagcaattaaaggactgttccgaggaaggctcaacaatttcctctgtacttctttctgtctaaatacagcctcttctagcaatgagcttgttacaagcagtagaagaaaatgtaaatattttcttggctgctatttacaagaaactgaatataaacagattcaaccatagaaccttattagataccatacctaagatgtctgttttacagtacattgaagagcttttgcccccttctttgtgttcatgtgctgtgaatttttttcttccattttgatacaaaaataaagaagacctcaagcagaaatttgttctatctatgactttttctaatattcctggaaggcacaaaacatgtatcaggatgaatttacacataacttgtgaccaaaggtagaattactcaatatactacatgattattctgatgggaaaacactacaaatggcttttccagcctgctgactgactgacagaatttggtatacatttcagagttaacaccatgtgtctaaaactagtcatttttgcggacttcattttgcattgtctgtggaattcaagagaaacatgtctaatactacctcctgtcgaaaccaaaaatgatacatgaaaggcccaagaaaatgccaaatcagaagattcattctgcaaatacttactaacactctctaatactgagcatcagatagagtgaccaataggacatgatttctgcttcaatgattataaagttcaggggagatgacaggcaaattggtgattgcaaagttgtgtgatgtgtgctctgatggagatgagcccagagtgctctgagagcagaggttagggtgttaaatgatggaagcaggagggtgttctagatggcttctcatcagaactaacatccagtctgggactctaagtgactaggtaagaggatgggatcgaatgtccatggcagaaacaatggcatgtgcaaaagcccagcatcaacaagaaggatcctaatgaatccaaggagctgcaagaagttcaatgtgcctgggtagagaagggtgtgggatgggtctggaaagaagtgagactggaaatctcattaggaatgagctcatgcagcagcctggtagccatggtggatattgaaactgcccaagagcagtggaatcaggcactaaagggttttgtgtcaatgaatgttatggttagatctgtgtttggatgtctcactacatagcacaggaattaaattgtttctagtataattgctattcattgtacttagagcccaaatttctaaccaatacagagaataaacccaagaaatgtcagaaaggaaacaggtccattctgatttttaggtcaatgctctgatatttagggtaacaaagttacatcacagttttgctggcaaaaactagagtggagattatgaaagaagtagtatctccaataggaaatcttggcatcttagccacatgactgtgaatgcatgcttttggttttgcatcaaggatcactatggcaaggggagtgttcattctacttatgcagaaaaagtaagaaggactgagaataacatatcttaaccatgtaaaaacaggcccttcatataagggaaattaaagagtacgattaacgtcctgccagactacatgttagaatcacctagggaggttttttaaaatatcagtggcttggccacacccctagatatttttacttgattgagctgaagcagggtctagacatttgcattttttaaaagctccatgagggatactaagggataaccagagttgagaaccaaagctgtagtggttaagagcacgggctggggaataaggtagaatggattgaaattctggctcttgctgaaaacaaaattatttctgttcttttaatttctaatttataaatcttccatgtggcattaaaggtgacttatatagatatttccatcacaaccagataaagtgtaatgtagacatgaaaggaattcaactcttatgccctgcccttagtttcttcatttgtaaggtgggcataacagtatctaccttatatgatctacgcaagctttgaacatgttaataagtaaaaagatttataagtacctggcatataagtgtttgatagatgtaagctattgttcttaactcaggtgaagttcataggagaaacaggacagagaggagagaaatcacaaagcatgtttcaaagacaccaattagtttggctgaggcctcagggagtaataggtaaaaaacttacaaagtcaagttggggccaaatttctttcttgagctccaggctaatgttgaaatttcagcaagtgttcattaattggtcatctaataatgtagtccccaagcaggtaagaccagcaggtgtatattgtacaaaatagaataaatttaaggattgctcagagttcattccaaaacttgggctctgatttgaattgaacccaaatgtggaaccaacagatgtctctgtggaaagttgtgattaagtcaacatagagcttcacaaatgaacagcgagtcactggttatgaataacccctggcactcaggaaggcagatgcctttcctggtgacaccttggctcttgttaacagatacagccagctccacttctgttgtccagattttgcccactttattagaaaactctaaatagtgctgaaaactgtttctgttctttctctttttatttataaatattttataaaagagcaaatgtaacttacatggacaaatcccacacagcaatgtaaacataaaatgtaatatagacatgaaagaagtaagaagacaggggaaatgaggatgagatgtttaaaagaaagctgggagggaactgagagaaggtcacgcaatcctataaatatgccaccaatgcatcgcaagtttggctgtaagccttctaacaggcaatgcaaagagggaaacaagattggttacaagatttagaatgttcccagcttaatccaggctgttgcttaatagcacaataacattgtgctattcttggcacaatgttaaagagaaatatgtccaggtctacataaagagaatatagtttaaaatagttgtattagtccattttcttatggactttcttatggtccattctcttatgttgcttgtaagagaatatctgcatctggttaatttataaataaaattatttcttacagttctgaaggctgacaagcctaaggccaaagggctgcatctcgtaagggccttcttcctaggagtgactctgtaaagtcccaaggcaacacagggcataacatggcaaggggacggaatatgccacctcaattctctctttctcttcttataaagccaccagtttcactctcatgaaaacccatgaatccattaaggaattcattcattaagaaatgaattcattgataagggcagagtccttatgacccaattaccccttaaaggccccacctgtcaatattgccacactggggattaagttttaacataagttttggagggtacaaattttcaaaccatagcattctacccctggcctcccgaaactcatatccttctcgcatacaaatatattcatttcaaccccatagccctaaagtcttaacttgttctagcaccaactcaaaagtccgtctacttttttgtgaaatcaaaacaaggcatctacttccaagacacacggtgggagagacatagggtacacattcccattccaaaatggagaaataggctagaagaaaggagtaacaggccccaagcaagtccaaaacccaagagcagacattaagtaataagactccagattagccatgtgcagtggctcatgcctgtaatacaagcactttgggagatggagctgggcagattgcttgagcccaggagtttgagaccagcctgagcaacagacaaaaccctgtctctactaaaaatacaaaaattcattgggtctggtggcacatgtcaatagccccaactacttgggaggctaaggtggaagttttgcttgagcccagagtgggaggttacagtgagccaggattgtatcactgcactccagcccaggaaacagagtgagaccttgtctcagaaaaaaagactccagaataacagaatagtctcctctggctccatatctgcattttctgcacaccagttgtggttgggcccccaaggccttgggcagtccaacccctgtggcttggctggactcagtctacccagctcacttagggttgcattgcacactgttctctctacagttatggggtcttggtgttagtcccactcccatggctccattaggcattgttctggtggggactccctggagcaccttcaacgcacctttccactcagcattgctctagaggaagttctctgtggtggctccaccccagtgataagtctctgccttgccctcaggttgtctgacacattctttgaaatctaggtgaaggctgccatgcttccatagctcttgttttctgcaagcctgcagaattagcaccactttggtgacaccaaagtttatggcttgcatcttctggggagtgggtttcatctcaattaaggccacttgagccacagctaggatggccacacattgctgtaccagggttctgggagcaaagtgtcgtggtatccctgagcagcaagcccatgtagagagtgtcaggcctgtcccctgaaatcattctgccttcctagccccctgggcctgtgatgggagcagcagcctcaaagatctataaaatgcctttgggatctttcttccattgtcttatggaataatacttggctcccttctatccatgctaatctctttaggaaacagtcactgggctacaccattggtttttctctcctgaacatgctttttcactttttacatggccaggctgagagttttccaaatctttctactcttctttctttttatttataaattctgtcttcaaattattcttttcctcccaaatctcagtgtaagtggacaaatgtgaccatgaaacgtctatattttgcatagaaatttcttctgccacataccctagtatatcactcttgagtttggccttctacaaagctgtattagtcagggttctctagagggacagaagtaatagaatatatatacatacatatatatatatatatatatatatatatatatgagtttatcaaggagtattaactcacacaatcacaaggccttacaacaggccatctgcaggccgaggagctaggaagccagtctgagtcccaaagctgaagaacttggaatccgatgtttgagggcaggaagtatacagcatgggagaaagatgtaggctggaaggctaaaccagtctagtcttctcaggttcttctgcctgcttttattctggctgtgctggtagctgattacattgtgaatgcccagattaagggtgggtctgcctttcccagcccactgactcaaatgttaatctcctttggcaacaccctgatagacacacccgggatcgatactttgcatccttcaatccaatcaagatgacactcagtattaacaatcacaagtccattccttgtcaacttgaatgcatatacaactcctgagatcatacataatcttcaaataaagacaataataagatcataattatgcctaacataatacaacttcctttgaacaactggaactgcaccaatccccaactcaaatgctattacataaagttaacaacacttaaatgccaatatgaaattgatatggtttagctgtgtcccccccctccaaatctcatctcaaattgtaacccccacaattcccacatggcatgggagaaactgggtgggaggtgattgagttatgggggcagatctttcctgcactgttctcatgatagtgaatgagtctcaaaagagctgatggctttaaaaacagaagtttccctgcacgaactctcttctattgtctgtcaccatgtgaaacatgcctttcacctcccaccatgattgtgaggcctccccagccacacagaactgtaagtccattaaacctctttcttttgtaaattgcccaatcttggatatgtctttatcagcagcatgaaaatggactaatacagaagtcaataaattttagggcacatgataaaggaaaaaggaaacaaaatgaagattttttatagcacaagtgtatacatgcacaaacatgtttttaacaaaaggaggaggaaatatgacaattacagccctcgtttctgcaactggtcacgtggtcatagctggtattaatgactagtttcttctactacccattctgtattccctttgccttcagcaaatgcctcaagaggtcatgaatttttcctggtagagtgacccaaaccttcattcctgaagggtctgggccatttgtagtcctgcctggattggactgttgtagtttcccattgaccttagtcacagggaatggtaatactaagatctcttgtattccacacatactcttccttacctccattgtggaatagtagactgattttatcttgataatacaggtcagtcaccgcagccaacactgtaacccccttcttagcctgttgacttaaaggtagaggagcccaaagtgtccaggtggcaatcttaacttccaatttaatggaatcattgttgtgtctcctggtggcagtgttcctccctctggaactatatctgactaaaattaagggatcttctacctcagtaaaatttctaggggtccagtggtgttgggtctgtcgagatattctttctaaggtaaagaataagttgctgcatttggccacccctacaaccaagaaagaaacacaaggcctagtgggcctatttggattttggaggaaacatattcctcatttgggtgtgttactctagtccatttatcaagtgacctgaaagactgccggttttgagtgaggtccagaacaagagaaggctctgcaacaggtgcaggctgctttgtaagctgctctgccacttgggctatatgacccagcagatccaatggtgcttgaggtgtcagtggcagatagtgacactgtgtggagcctctggcaagcccccataggtgaatcacaacaaaggcctctaagattttagagcaaagccctgccatcttctgcagattactactctccttttgagagatagctcttggcctgttactgggctttggtggaaactgaacgtttaactatgggtcatcaactcatcatgcaacctgaactgcctatcatgaactgggtactttctgacccatctagccataaagtgggttgtgcacaccagcattccatcatcaaatagaattgatatatacatgatcgggctcgagaaggtcctgaaggcacaagtaagttacatcaggaagtgtctcaaatgcccatggtctccacctctgccaccctgccttttctccctcagcctgaactgagggcttcatgaggagttccctatgatcagttgacagaggaagagaagactagggcctggttcacagatggttctgcatgatatgcaggcaccatctgaaagtggacagctgcagcactacagcccctttctaggacatccctgaaggacagcagtgaagggatatcttcccagtgggcagaactttgagcagtgtacctggctgtgcactttacatggaaggataaatggccagatgtgtgattatatactgatacatgggctgtagcctagtcttcctgttttcttagccctcaccagaatcctgctgctccaaattcttccagcctctgcccattatgcagttgcaaagttgcttccacattttcaggtattcatgatcaccaccaccccactccttatatcaatttttttaattagtccattttctgttgcttataacagaatccctgaaactgagtaattattaaagaaaaggaatttatttcttacagttgtggacacccaggagctagctgcatctggagagggctttcttgctggtggggacttggaccagaatcccaacgtggcaaagggtattacatgtcaaaggggctaagctaatgtgcttgctcaggtctctcttcctcttcttctaaggccatccattcccctccaaagacaactcatttatccatgaggggattaattcattcataagggcagagcactcatgtgactcagtcatctcttgaaggccccacctctcaatactgttaagttttagcatgagttttggaggagacattcaaactatagcaatactaatattcttatcacatttcaataacccagtagagtttatgacacgtagtggctactagtgagtgaatgaaggaaaaaagaaagagggaggcagggaggaaagggaggagaagaaatctatattctaaatctacaaaatgtatgggatgctttgctaacaataaggtagtatacacaaaatggctcagtgtagccatcagcactcaactagtctgactgaaaccagaaatggattttagtgcctgcagaaaagaatagattaaatatctcacaggcaatctttactataaactgtttctctccatcagatagctgataaggattgagggtcagtaatttcatgttatagtcctgtatacctccacattcttgattcagtggcttgatgcaatagatatttacttctcattcacataaaaattgattcaggtgtaggggtagctctcctccatgtggtgatacaggaagcctctgaatcacctctgtatcgtggctctgttatatatgactacaaaaggcatccacatcaagtggcagagagtagagaaggcccatctacttcgtaattaccttggctcgaaaatgactcagattacatacactcaaattccattggtaaggggttccaccttgttgcaaggggcctgaaaattgcagtcctgggtaagacagcctcttcctggtaacatccttcctctaagaagcacaagcacagaaccctggaaggcagctacctttttccctcactattcttatatctggccaccaaatatctgtgcctacttttcccaaaaagagacagccctaagttctacccttcaagcatctacctcacagtctaggatctccaggtcatgaatagtttctccatcaggtctgtattagtttgttttcacgctgctgataaagacacaccagagactgggcaatttacaaaaaaaaaaaaaaaaaaaaaaacaaaaaaaaagaggtttgttggacttacagttccatgtggctggggaagcttcacaatcatggtggaaagtgaaagccatgtctcacattatggcagacaaggagagagtttgtgcaggggctctcatttttaaaacaatcagatctcctgaggctcattcactatcacaagaacagtgcaggaaagacccgaccccataattcaatcaccattcaccaggtttctcccatgatacatgggaattgtgggagttacatatcaagatgatatttgggtggggacacagccaaaccatatcagggtctaaatgagattcctcctcatattctgaccttcctataaaccacaacatgagtcatctatccctcaccgcatcccaaatacaaaacacataggtgttgtgtcaggagcagaataactgcaattttaaaactccctttcagagaagggaagaaaggaaaagaagcagtgatcaccatttcctaacaaagtgagatcctgccaggcaggcattgtaaatatccccacttgggagaagcccttggtccctttcctccatggccctgtctctacagcctcgacaggttttctttttcatcatcctctatggcctcatctgaagggagtgtcaggcagtgtgcccaccttggagctccatagctctcataacctacttctttatacaaatttggaagtccaagggttgctgtagcctcaaacagtgaaatacgttttttaaaaaaatcagtgctagtcttttgggtaaaatagttctctcaagtactcagacagtccctagtctttctttctcccataagttatacctaccagtgatcacatccaatgtaattccctagagtcctcaagtcttcttctttttctctgtcactctcgtgtgacaagcattattttctcacattgtccaggtgaagtcacaatacctcacctaactgaagggaccctgggaattgtagctcttggctgagctttccagtaacaatgctacaccatgtaaggaagtacaaatcttgggtgaatagttaaccattgtactatagctccctaagaatatttggaggaatatgggtattctatatgcatgtaatataaaatgctgctgctagctcttcttttaaatacagtggctctcagggccaagtgtggtggcttatgtgtgtaatctcagcactttgggaggccaagtcaggagtattacttaaggccaggagttttagaccagcctgggcaacacagcgagaccttgtttctacaaaatatatatatatatatatatatatatatatatatatatataaaataaattaataaataaatacagtggatctggatttaaatcccagcttctccgtttataacttctatgatctcaagcacttctctattccttctgaatgccacattttgttatctacaaaatattggtagctgtacttacttcacaggattgtttaattaaattacatatttatttaactgatcaatgatggttgagtaattcaaaaagaatatggacagttatcttgagaatagagcccatatctgtgttcagtttttgttataacccaaagataattaaacaaaacttagacatgctgatatttacatctctaagacatttcatacattataaactttgcattttgagcattttattttctttgctgcagaattagctggtttactgtgacatctgcttagcagattatgtatagtaccttttctatttctgccatttttatttttgcattttgggaaagtgataacgaccactccaatttagttggaagaaagccttctgattgcacagtgtttgatccaaatttgtgtagtggtaggacgtgcacttttgtagaattcagcactgaaggattatctactttacaagaatattgttttaattagtcgacaaatgaataaatgatttatgcaatgaagtatgggcaaactaattttctctgaagaattctccatagatatttatattgaacaaatatataaatactgatgcagttgcagacactgaaattagcattcagcgtgaaaattttttgaaatgagttccagctgtaaactgactaggagggaattcttctatttggataagatgtaagaccccttggcctaaatcggtggttctccagtattagcatgcatcagaatcacctagagggtttatttaaacagatgattgggcctcatcttcaaagtttcttcagaggtctagggcagggatgaaaaatttgcatttctaaacaatttccaagtgctgctgctgtacttgagaacacattctgagaaccacagcctaaagcagaagttgggagaactacattttgcataccctatctggcctaacatttgttgttgttgttgtttgtttgttattttgatttgttttctaagagatgggatttcactctttgcccaggctggaatgcagtggtacaatcacagctcactgcagcctcaaactccagggcacaagtaattcttcctctttagtctccaaagtagctgggaccacagacacataccactatagccagctaatttttctttttaattttttgtagtgatggggtcttgctatgttgctcaggctgttctcaaacttctggcctcaagacgtcctcccacctcagccttccaaagtgttgggattatagacatgagccaccatgcctggcctatttttatacataaagttttactgtaatacagccttccttatttatgcattatctatagcttctttcacactatgacagcaggaataaatagtcacaatggagagcatatggcctgcaaagtcaaaaatacttaatatctgttcctttacagaaaaagtttgctgatccctagataaagaatagggaggtgagtgtggaagaagacagcaagagtcctggccccctcccttctatctgagcctcacataaattcccttcaataccttgagttagatattagcaggagtttgccagcagcgtattcaattataaggacaaatcatttatatatgcctgtcattaaataataaaaattaaaggtaattgaattacccacttcagtacccagtttattctagatggacagaagacttatgtctaaaaagaatcacaaaatcagctttcttctcaaacttatggcttctagaaaagacatacaggttaactttcccttttgaggtgacaaagaagctccatcaatttgatgaattgttcactgcatgtccagttaattagacacactctgtcatctgcatccaaagcacagaaactgaaacaaagtgtctatggcatagaaccaaataatctgaatacaatcactacttaatgaggtcatcttcagtggagtggagtagtcagaatggacagatctgtatcaatccagtgacttcttggctttgatcactgtactgtgctttaccttaggggcactaattatccatccattgcatttctgagttttccaacagtgaaagttggagaatcagattctctttcataatgttgggtcagttgctgtcaccatttggaaaagatatttttaaaggatttgtataatgttggaatgatgccccatattttaaaagtgggtaaagaaaagtgagctagcatttgttaaatatccatacgtgtgccatgtattattgtaggcatttatgtttatcagctccaacacacacaatgcagcctcctaagattagtggtaagattattctattttatggagaggaaaactgagatgtagaaaactaaaagaactttctcgagttcatctcactattgagtgctagaaccaggattgactggttgtcagtcattgactggctgtctaaaaaccaaactgttggctactccattctgtccactgcagttccctcccctaaatttgctagatttgataactcaattcatccactatgcatcacttgctcaggatccactcattcccccagtgaactcttgtctgctctacagaaattgtccttgttccagaaccattgctccaaaactctccagtttctgatctgatcattaacaagccaaaggtttattccaaagctctagacaacagttagatgggtgtggatggtagttgaaaattttaaaaaatatacatttgcacagagtagtgtaactaaaaaccataggaagcaaacccagactcatgaactgaataatgccaaggctggcaaataattttcatctcttgagtgaactgtgatcacttgttagtagctgctgcaagcctgtgtgaggaagtattctgaagcaatgttctgcctaggaaagctatattctgttcttaggaaagaatgctgtaagcagtaaacaaaagaatcaacatgtacagcacgacttgccagatatggatctaaacactttattaagttggttaatcctgcaataatcctataagataggtacaaaggagagaaataaagcaccaaggttaaataatttacccacaccacacattcagtattattaagtggcagagctgagaagtgagctcaggaattctgctgcagttggtggagggtgtgagcagttctgccagagagcagtagggtgtgtgagagacatttgcatccctggggtcatctcctagtaaaaggacaaaatgaggaggagttctcagggcttcttaaactgttttgtgccttggagcccttaacagtgttataaggtccacagacaacttctgaggataatgtttttgaatgcataaagcaaaaatataaggcaactaataaaatcaattatattgaaatctgattttcaaaatatttttagatgtaaatttgtgagacagtaatatgcatacttctttattaatacagtaaataacaagatccatcagtgagtctaatagaaaccagagttttaaaataatgaagagcataaacaatgtttcaatgactctattaatacgacgactgtactgttaaataaaaatctttgtgatttctatttgtgacaaagtcacaggtactgctaattcaagggtagtttgttgcattctttcataattgaaggagatgcttaattgcagttaaaggttaatggaaggaaagaggtgatttttttttttttctatttaaggccacagaccctgtgggtctatccactgaaacttcaaagtacattgagtacttcaactgttaatgttgtaagaggaaaactggatatgaaaggcagtagaaagaaatttaataacttctctgtaattgtgtaacctgaataagtcagctaacgtctctgggttttcattttctcactgtaaaatgggactaaacctctcttattagactgatgtagagaagaaaaaacaataatctagttggaatgacattgtgggctataaaacactgtgttaattctaagagatcttaataactgttagagaagcagccacaagttagtatcagaatttgagctgcctgttactcaggtttcattagtgctgtttaaaaaaacacagcttcattggctgcctactgtgtgtccacactagatttatttccatgctaaggtacaaatacaaccttcaaggagattggagtctactgtgggaaaaacagatacatctccacaaaatagtgaagtacagtgaaagagaaatgcacggaaaagatgcagggaaggcttcctgcaggaggcggtgtaccaagccttgagggttgagtaggaattaggcaaagaaagaagtattgatgttacagctacggggaacagcatcatacagagcacagaagtaagatatgggctttgtatgcaggaaatgagactcatttcatcatttccaaaacatgaagtaccaaagacaaaaggggagaggtaagggcgagaacagagaaggtcctagctgctttgttagagaatgtaggcggtattttacagaggatgcgagaccctaatgtcttctaagtaggtgatttacatgatcaaacttatgttttagaaagaaattgcaaattggtgacctagaaaaatctaatttacatatgtgttggcccaatatattgaatttcttcttcctatatttaaaaataagaagactaccctctctccaaaaaaacacaaagatctaatatctctgagtccatattgcacatggcatctgagtaatgatgtcccatttggagcagacatgggctcttcaggtggctataatctccccacttcctgtttccttgccaatgctgagcccacatgagtgtggccatttatcatcaagcttaaagcacatttttcttatggtgaagatatatttctttgtattcatgtctacatgagtacagagtacttttggtaaaagtgggaaagtgaataaacaaaaggtctacatgcttcaagaaaaacggaaaagatatttccttccttactctagcctgctcttctcactcacaggacctgcctggagctggacattgtgtatgcagccccttttgccaggcacagcgcaggctgccagactcatggaaaatgggttttttgggacagaactggaggcaggtagaacagttagatgattgccatgatccacacaaggaatgataagagtgggagttaaaattgtagtcctgaggatggaaagaagggatgcagtcaaacaatccattggagacaatataaccatgggattcatgattcattagctttgaggataatagaggaaaagagtgatttgcctactttctagtttgtacttggaggctgtttatgattcattcaactaaaagactaggaaaggaaaggcagatttagggtgaggagaatggaatctgttgtgaacatgttgagctggagataaagttgggacatatatttagcaatgtttaacagaaaattggatttatgagcctgaagacaaagaggtctgagttacaagtttgaatttaactagtgagcctcagtctgttggtaagtgaagccatgaaagtgaattctatcactcaaggagagcctgaggctcaagaatggctcatgggcaggtgcccaggcaacagtgtattttaaggatcagatcccattaaaaggaccctccaaacaccactgcacaagagtgaaaagaatccagagatgaaggtgttatggagaccaaggaagtagatttttaagaagtattaaatgcaataaaatatgaagaaaagggggtcccaacattttggaaatttgaaatgtatagttgctcttagtgaatttcagtagagttataaggacaacacaagatcctaattacatataacacttactacatgactctagtaatgtagtcatgtctgtagtcatgtagcaagtgttatgtaattatgatctgatgttgtgcttatatctctactgcaactaaactccctttacattgtaactcatttgaaactacaatcttatgagattggcaccttggttatccccattttacaatgaggaaactgaacgaaaatgaagttacattactttcctgaagaaacacagcaaataagtgatggaattaaagtttcaaattcaggcagtttagctccagagtccaggctcttgacttcattactatgaaactatcttttcatattgcagtgagtaacaaatagggtagcccagtttatgcccgttgtcccaatatccaggctatgaagcagtcattttccagatttagataaaaaattacatctgaccacctcactcatgcaatataaggacaataggaaaataaatattgtaagcctagacagttctttttgccatagtgtctcataatttgtaagtcctcaataaacgtctgttaaatgaatgcatcagaaatattcattatgagagcagttgactgatatccagagggtaaagactagagcatattaataagactgaagggaggttgtcagtagaggaggaacttgaaggaatgcaagacaaagtaaacgactaatttagtgatgtttcaaaagagggagaaagagatggtgctgaagacagtcctgcatcacaaaggaaaaaaaggctattaggccttttccttgaagtcatatccccatatccctgtcatcttccccttccatctgtacattcaaaaatattctgagcacaaaagaggttgattttggggaaaaaaaagtataacagtgaaaacagaagtgggatttgtataggtataatgacatgagaagacactggacagaaagacaacaagaccaaactgacagatgagactctctccacatcatagggatcagagccatctgttaagaatgaaagagttgtgcgggctggaggggagaggtggtgatatgaaatgggtcattccaaaatgagacagggagttagctgatactaaaaggattaaaggtcagttctgatggcctaacttaagtgggagaccatacatttaatgtgacaagcaagttttgtgctgttctgcatggaggttttcctggacactgtgatgacaggatggaaccgtgaaggaatctggatggatttctgagggaggtgttcagatgatcacccaggatagaaggaaaggccaagagaggggaggatggctgggagaaaacaaaaggacccagggtctgaatgcttccatgatggtgaagagtaaggaaggaaagaaggagggcctgagaaggcctgaaggacatgcggttgtggtctaaaaggagaatttagttttaaggagccacattgctttcttatgcactgtacttttattagaacatgtcggctgggcgccgtggctcacatctgtaatccctgcactttgggaggccaaggtgggtggatcacctgaggtcaggagttcaagaccagcctgaccaacatggtgaaaccccgtctctactaaaaatacaacaattagctgggcgttgttgcaggaacctatggtcctagctactcgggaggctgagacaggagaatcgcgcaaacccaggaggaggaggttgcagtgagccgagatcacgccactacactccagcctaggcgacaaagcaaaactctctctcaaaaaaaaaaaaaaaaaaactagcaaacaaaaaacctggtaagaacatgtctactactatgcttactcagccatggaaaatgccctatattgtgtcaagcagccatgtgagtttgaattctataccaaaatgaacacttggaatcatgtgccccagtcaaagaggatgtctttgttttccatcagggaggcatccagggcatgtgtgaaattgattgtaaatcatttgtgttgttttctagatattgaacatgcccatttaacatatttaatgtgtttctgacatttacaaagtgtctggcaagctttgggcaatcattatttaaggcatttttactgaaagtacccctgagtagttcctaaacactgcattctttttcaatcgattctgaatatccctgaagagggaattgtaaatgttgaaaactgtagttgtcaatcatgggctcatctactcgcctctttgaatgataatataaattcatttgaaacactacagtgttgctagatacttggggcttttttccttgctgctatagaattgctttatttcagtaagattcaaaaaatgaattaatctccagagacataagcgcttactaacctcgagagtcacccgactccagatttttgaattctttttaagaatgatggggtttgagtaggtcagaggtagtgccccaaaccctctgtcttgacaagagagccattgcagactcctttcacccttgtttaatttgtgctggggactgacaggtcctatattaggatgtgaaaatgtctgcaatcagaaaatgcagcatgtttccaaaatgacaaaaatggtgcatgttgtaaatgcaattcttcttcaagtcacttttcattcctgttctgatcaaaatgcaagctgtaacactatcctcagcaagtctggaggcttctggatgccccaaatgaggaggatggcatatatatgggcttgaaccaccaggtgagaggaggtatgtagtggttttgtagatggaaaatgcaaatacaaatctctttgttcttaattatatttgatacattctctgcatagaatatcaattctatctaatgagaaaatgtacagctaggccatttggcaatgggcaacagattctgtgtaagcatctggcaaaggaataatttgacaaatagcaatatgccgaaattgtgttagataatttttgaggaactatttgtcagggtgaatgctcattttattcctgggatgttattcatcaacgccatgatttaaatgacaattagctacaaggtttacattgcagctgagcttttcatatttcccataatcctctgcatgcatattctttattgataaagatgcagtaacttctagggcctctcaccttgacactctgctggaaatctgaacttcactctcgggtgaatctgagtaaataaaggcttaaggagaagggctgaaatgagaaattaattctttgcacatcccgtggaagttgaagcaggttaacagatgttctgtaccaatggggcacctacagcaacttgtaaatttatagcactgactgcaattgtgttgttaaatgaagattctgcaacttcacaatgtgagaacctacagtagttgacacaggaattataaaagaatagtggcagcttttccaggctctccagcattatttctataagaaatacaggatcatcatatgtactaagtcccttaaatattcttccctgtctttgaattcttcttcctttcaccccatctattcatttgcttctactgaacttgattttactagcattttgagccccattgtccccaacctattccccagcctatcacatcccagctggccttgatgtccttccttcccactctcagattttagggtcagctatctgaaacagccttgtacaagaactgtgaatttggaagcccatatctatagttctccactgtatcctgtttgatatagcccagagctctggattaatagaggaatcccttacctctatgcctattcctgagcttctaagaagggttggaaatcttgagccatttggacactatgtaaggaccagttcttccatcctcatctgagctcttagtgacaagtttttgttactgttgttgctggtccataacagctactgtttcagatcttcctttccctccttgagcctccacacccacacttattcttctattcttcattacaagttgcataagaattaccaaaaatgttcacttaaaatgctatgtccctaaggccaacccccagctattctgattcagtaggctagggtggcatccaggaatctgcattttttatttgttttcatttttttaattgacaaataaatgtatacagttgactcctgatcaacacagggttaggagcaccaatcccctagacagtcaaaaatccatctataacttttgactcccccaaaacttaactactaatagcccactgttgactggaagcttcattgataacataaaacatcgataacatgtattttgcatattatatgtatattatacactgttttcttacaatcaagtaaactagagaaaagaaaatattattaaagtcataagaaagagaaaatacatttattattccttaagtggaaatggatcatcataaaattcttcattctcctcatcttcatattgactaggctgaggaggaggaggaagatgaaggcttggtcttgctgtctcaggggtagaaaaggcaaaggcagttggaggaggtggaatggggaggctggagaggcaggcatacttgatgtaactttacagaaatgcatcataacatttgtctgatgtttttgctttttcatttctctaaaaatgtttctatatagaaccaattctctacccaccatttgctttagttttggtacccacgttataaaagaagtcaaagcagtcttcaataattggaatgcttctgccagactgtccaaggtcaatttgttttctgacactgcttctccatcttcttcctcatcatcaggtttcgatgcattcatctccatcaatttgtcttctattcattcctctggtctggtgtgcattagctcttgagtttcttcaagatccgtatcctaaaacccttcatcccccaattttttttttgccatatacatgatcattttcaagattttcttgattggccctgtcatgaattctgtgaagtcatgtacaatatctggatacattatacattctccagcaggaatttattgttccaggattgatagctttcacagctttttctgtaacaccaatggcatcttcaatggtgtaatccttccagactttcactgtgttctctctcagggttctcctacatagcactgacaaactttttatagagtgtcacgcttaaggagccttttaaaggtccttatgactcccttatataaaggttgaattaaatacatggtgtttgggagcaagtagattacttgatgccttcagtgttgaactaataatggaattctgggtagccaggagcattgtccaatattagaagaactttaaaaggcaattatttactagcaaggtacttcctgacttcagggacaaagcatcaatggagccaattcagataaaaaggattcttgttgtgcaggccttcttgcacaacaaaaagcctggaaattggtatttatcttttcccttcaagactcaggggttagcaactttatatataagggcaatcttgataaaaacccaactgcatttgcgcaaaacaatacagttagcttcctggcttaaatcctggtgcttgcttctgttccttaccaataaatgtcctttgtggcattttttcccctggaataggacactttcatcttcatttaaaatctcttcaggcagatgctctttctcctcaaaaatttgtttaacagcatctgagaattggtctgcggcctcttggttagcagaagttgcttctcctgttatcttgacatattttaagccaaacctctttttaaaactattaaaccatcctttgctgccattaatttctccaggtttagatctttcaccttccttttgttttacgctgtcaggtaatgacttctgtttttctcaaatcacattggagtctatgggtatggctttcttatagcaatcttgcacccatataaaagcttcatttcaatatgatatgaaaaggtatcttgcaaaaaatgcaagcttttgcgcctgctggcatagttgcagctacagcttcccacttttcttttttctttttttacaatggtccttaagccggattcattttatcttgaaatgataggcaactgcagctgcagacctcaatcaagcaattcaactttttcttgtaatgtcatgaattttctctgtttcctaggaacacttcaaccatcactagtggcacctcgtatgggtcccatggtgttatccaaggtttatgatactgcgctaagcatgatgaaaaattcagaagaaccataagagatcactttttactgcagtatgcaatttactggagagatgtactgttcacttggagataattagagtcacatggcattttaagtaggtacttgtaacacttcaactcactgcaatagcaactgtagggggctacaaaattacatggtagtatactatgtgctacagttaattttatgcagttaggattaatagtgcatgtttatcttggtttatattctctcaactgtgaatggctccatgtatggcctgtaagtgtgtgtgtaaattttaacaaattttaactttttataatagatttatgcatatattatggttgtaaatgatcaaatagactactctctaaatatatgttatgcattcatgacataactttcttaacatttttgctatttctaggctacgtagttcatctgctagtttttcaaattgtcacatgtctaaaaaattgttttgaatacatttatttttaaaaacctacacaagtggacttgcactgttcaaattcatgttgctcaagggccaactgtatatcaactacaacatgttgttttgaaaaacataaacattgtgaatgtctaattgagctaatatatgcattacctcacatatttatcactctttgtggtgagaacacctaaaatttactctcttagcaattttcaaaaatataatacattgtcattaactataatcaacatgttatatgatagatctcttcaatttctaactgaaattttttatcctttgatcagcatcttcccagtcccctccttctccaagctcctggtaactaccattctactttctgcttctatgtgttcagcttttttagagtccgcatataaatgagatccaagatgttttaacaaacatcttgtgattctgatgacattgtcccatagaccatgatttgaaatactttgaaatagtttaccctatcactcatgggtaagctcatgggatgaacccattagacattttaatgatctggtgatatggtctggatttatggccccacccaaatctcatgttgaattatagcccccagtgctgaggagaggcttggtggggagtcactggatcatggaggtggattttccctttgctgttctcacgatggtaagagagttctcatgagatctggttgtttaaaagtatgtagcacctcccccttctctctatatttccccttctccagccatgtaggacatgcctgcttccactttaccttccaccatgattgaaagtttcctgaggcctccacagccatgcttcctgtacagtctgtggagctatacaccaattaaacctcattataaactacccagtctcaggtagttttattatatcatgcaagaactaactaacatatctggtcttattctactacaggagcattttatgaattagtacatggacatttgataagccagaattgcagcttgtttttcatgagaaccatatacctgttcattgttttataatttctaagagggctcaggaaagttaagcagtctgtccaaagtcatcaactcagaatccagtactaagacacaggaatctgattctaagtttattagtcatcccacttttcccaaagtggctttttagattctcaacaggaaataaataacatgttggcaactactgttatgacatttccagatgtcttatgtacaaacattccatatgaaggtcactttgaactgctggggaaacaatctttcatgcttggagtagagacatttttaaacagtgcttcccactttttttttttttaaactgtatcactacttccataagaaagggcaaacctgaatgtaaatccagttatacttagtaatatctggggcaggttccctgggaaacagactctaaaacagatttactttcgggaggtttattgagtaacgacttcaggatcaacatctgtgggagaggcagggcaaggaaacagcaatctacagaaaaaggagctgaattgtggtacagtcattgcaaagcattagccttgttctcacagcgagaattcttcagagtttttctcctttaggcaaagaagcagccattctatccccacatttgcccgtcattgagtgcagggtgctccctgggaggggggtaccattttgggcaaggaagtgctcatcagctgagggcaattcccattgcaggagctgagggaatgagtgtcttgtcctgagaggggagtggggaggatcaggtggcaccccacaacatccattacaagtaataatttccttaacctgtaggacaataagcaataacactattttttaaaatagtagacaggttttataacattaagagcacttgaagttattggaaaaattcttcccatactttgatcttgagttcagaagctatatcttagagagaaataaataaaaatttttaagtagtgactcattttaaagaaatgctatttttgttctgttttttaacgcactagaagaataagtaatgattcagactaaactgttcattttgtaaaatacaagttctgagaattgaataaatataactaaatcctaactgtgaggacaaaataaatgaaactaatactagttttatgggagctgaatgaaagtatttgcagttgatagaaagtattatctcatctttgaaacgaatgataaaatcaatacaaagagctcattgccaccttttccctaattccctatttacccatataagactttcactttaagatatcccagtcaaatactcatgaatatcatccccagtgaaagaaaagaaattgataaacaaaggtaaacttctcatgtgtaatcagagatacctgaagctctagaaactataataaagatgttgtgctttttacccttaaacttgggttgtgcttttaatatttgttcagattcacaaagtaattaacgaccctttacttaggtagatcatgagggaaacgtgttaaggccgtttattgaggcttgagagatggacaactgcatatcatctctgaaagaattactttatggttgttccttcaatctcccagtatggctaagaaatagcttttcttggtctcagaaggaaaggaaaaatgaggctttaaaaaaaaaatgccttctctcccaacagcaaaaatttagctgaaaattggctataggtggcattagtgaagttaaaaaagggatgggacaaaatatacccatcccttcaaatctcagaattccagatttggaaggaaactttagagcatcctgttccatcctagaccatctgataaatccaggtcctctcgtcttacctcatgaagatgtcaatacaaggatggcaggagattttgtttttttcttcagcatccactacctagggtctggttccttcagtataaaggatttttatttttttaatactgccactcaggtccaggggagagacagacttttagcataatatggtatagggtacatgctagcaggaacgtaactatcctaataaaatcaattgaactatatttttaagaattgaattcagaagtaagatctctatgagcacatcctcctcctcttctctgtgttatagattcagagcatctctcgctccttcctaagagtggaacccagagaaacagagagtgaatattcacctacatagttgccagagatgagaaaaggcagtacctggagtggctcgttaacacacaggttgcttcctgcctcccatcagcaaaggttctgattccatagacctgggctagggcccagtaatctgtatttcaaacaagttcccaggtgatgctgatgctgctagtctggggatcacacatagggaaccccattagactagaacttttccttcaaattttaaaaaatatatttaagaaaagaaatatatcttaaaatggaatcttcctccagaaacagctaaagaagatcagctcttagtgcccaagatagggcagataagagtccaaataacctggccatggccaggtgtggtggctcatgcctgtaatcccagcactttgggaggctgaggtgggtggatcccctgaggtcaggagtttgagaccagcttgaccaacatagttaaacctcgactctaatgaaaatacaaaaattagctgggcgttgtgatgcatgtttgtaatcccagctactcaggaggctgaggcatgaaaatcacttgaacccaggaaagataggttgcaaggagccaagattgcgccactgcactccagccttggtgatagagtgagactctgccaaaaaacaaacaaacaaacaaacaaacaaacaaacaaacctggccaggatatcctgaaggaacccaggccaatgaaagtgcatatatatatatatatatatgtatgtatgtatatatccatcccatctagagatttttagctagttggacctggctatgtgatccaattatttttcccctaccagcatccaatctgttctcagccgctctggctgttctcactgaatcttagtagaggtgacaaattgaagagggactgaagctttcaattagtataccacccttgccatatttctatgttcctttcataaggaaactctagtgttaggcagaacccaagcctaccacaacatatcaccatgatgtcagtaagaatgaaaccctgtctcagttatgttcatctgtcctcaagcagaagacagttgcctgtagtcccagttgtctttcctatagaaggcaattctggctgctctgtcctaggactcaggacaagaccatagacatgtccatctccactgattttctgatactccaccctgtgacttatgcccagttttctggtagcactttcggctgttaatatataatgggttaaatacctttggagaaaagaaacagtcactcctggagctgttgtctgggttgcaacaaagatgtttatttaggaaaagtggggggaaaatcaaactatgcaggaataatgcagttagtgattgtgaggcattgataaaaacagaatacattttcactgttaaaagttacactttggaaaactctggaaaattctcagtacaatggcagataaaaaagacaaaaagcttagaagatttttggctttttatttgtattttgctgtattttgagtattcctaaatatatatctacacttatatttttcaaaatatataattaaaaagaaataaaatttggcaaacataatagataactgatatggtttgcctgtgtccccacccaaatctcatcttgtagctcccataattcctacatggcgcgggatggacctggtgaggggtaatcgaatcatgggggcaagtcttccctgtgctgttctcatgatagtaagtctcatgagatctgatggtttcataaatgggagttcctctgcacatgccctcttgcctgccaccatgtaagacgtgaatttgctcctcactcacctttcaccatgatcatgaggcctcactagccatgtggaactgtgagtcaattaaacctctttcctttacaaattatgctgtattgactatgtctttattagcagtgtgagaaaagactaatatagtaactgattccagataaattctatagaaaataagatattctagttccttttcattactttatatctgattactactagttttgtcttaagtcatatcatcaggatagttccttgtcatagagtaaactgataattttaggcttacctaatatgctgttttatgttacgtggaattatctcctttgatagtaaccaggctttttccagatttaattatgacatatatcagagactccattgcctgacaagcaaaatgaaattccatggaatatacatattttagctgtcattggtaggaaaagcttcctttttgttgtgagtgtgatatgtttaccatttagtgaattccaaaattggaaagtagtaaggtaaacaaaacaactctcaaggcttgctattttcaatttaagtggcctctttaaaaatgtagattgggcaactcatataggcaaatgttgtcactctctacagggaccttgtgtgatccctagttcttagttatttggttgcttgtgattattataattttagctgaaagggcatcatagagttttctagcacatggatggtgggggcatagatttctatccaagttgacacattgatagagtcagccagtaaattaacagcagcagaacaccattaaattttaaacttaattgctgtctcctcttaatctctatggatataatcaatagatgtcagaaaaaagttaaagaagttatttagcgagcatctatttcctggagcatagtggaaaaaccactgtttcatttcagaactgatttaaacaacttgcaactaagatgctgtcacttataaggttttcatcaaaaagttttattttattcagttttttcattagcactttttttgacaagcatattggaattatcactgtgtaatcagtttgattttctctcaggatccgcccccacttatccttgccttttgtgttgtgtaacttctctactccatctttgttacttataaactccctttccatgtccacaatgaatcttgatccatgtcctgtgttccaaattttcatagaaaagaaaagctccatgtaaatagtgagcatgtccacatacccaaggagaagctttgctagttgatgttgggtgtcatgttgggtgaagtcaaaatcttatgacagttttttgttttttttataaatttggaaggaggatggtattccagttttattctccgtgttccatatctactgaattatggaccatagcatttacaggcaattacatagcctcctgaacagccatcttgagtaaaatggagactgtaataaaaaacaatttttaagtcagatttagacaaattcagtgagctacatggattaaaatctactcattaaatgaatggataactttttacattaatttcaaaataactgttttataggaccctttatagatttgaatcaacatactcttgatgaggtaggatgttatttcatttttatagacaaaggaacattgattttatgccattgtctttagccaagcagggaagaatacttccagcatagcccaactttctgttcatcagctgagcacctaccatgtaccagagactggtctatttgctggagctttgtagacaaagaaaacagacaaaaccctggctctcttttagcttgcagtctagtggggataggacagtgaatgaaaatgcaaaaagaatataaatgcattcctaagataatttcaaatagtgaaattacaatgaggaaaacaaaaccaggtagagagagagttggaatggagggagctcctttagattgaatggccagagaaggtctctcagagaagatacttggaatggacaaggaggatcccatctggtaaagttttgtggggagcgatgacagcaggttcagaatctccaaggtgaaaatgagtccataactcttggaaaaccatcagaagccccttctggttggagcagtgaaaggagacggtggcatgagatgtagaactgaggaaagccagggtcacatagtgcagggtcttgtagaggacagtcaaaactgtagatattttcatctaggcaatggcacatttttggtgggttttaagcaatggtagtgacattatatgatttgtttaaaaagtaatgtagccaatgcctgctgttggagaataaactgaaggtaggagggtggatgaaaggcagggtagtagtaagatatccttcctctctaccctttcattctgtagttccatatgtttagaataagcatgacactgcatgacttgctaagtgccaaaggagagaagaaatcagagatactttaactgctgaggcagatactgtttcccccttcttccttaatctacagaattctgattttatttgggcagcagcatacttagagaaggacagtccattctctagcctggaagatgagtcatgaagtcctaaaccgtacaaaataattccaatccccttcgctagtgattggcttaggcgtgggcatgtggctttattctagatactaaagaagaaatttctttgctgggtggatgggaggggagaggagcagagatcagtgataaagatcagtaaatgttattacctcttgataaaaatagagataacagagatcctctttcctctttgtgccttgaatactactgggaacaactagctttgcagcagataccttgtaaccatatagtgaccaaactcaacatgctaaagatcacagattagaaagacaggaagaatctgagtctgttgagcatcaaaactatataaccatctatgactagacagctgtaggtgtctaaagagtataagtcattattaatttggatgttccattacttgcagccaaatgcattctaattaatatatctgtgtgtaaatttgctaggtcctgtccagttcttcataattgaaaagtgaaagaagcaatgaaatccaaagtagctgtgagtgaaataacttagaaatttatttctgaagttaaagtctagatgcagatatttcagaactagaatagtgggtcttctatcttgctctcctgctggtgaaatctgttccaaagttaactcactggacaaggtggccacttcgtctctagccacaggtccatattctaaccatcaggaaagagaaaagacagagagggatatggcctctgaaggacaaccattctacttatatccatttgctcttagtcacatgaacattcctaactgaaaaatgttgtctgtttgctaggaaattatgtatacaacaaaaacttggggaataagttaccaaaagaagataatacactaggcaggggagtaaggggtgggataggggagggaattgcaggcagcctgtcttccacacacaactgtaacaaaagacgattggatatctgcctattgagaactgactgtattgtataattgttatggtagatgttatcatttgttgagtgtatcaggctttgtacttgaacttgttgctaaatattgcacttattcttctacttctgggcacatgataggcttatgaatttcctggcactcttgaggttgggctgggtatgagtagagttggcatacttcacttctcggtaaagcattatttattaatttgtgaccatacagagagtttctcctctgccacagtagctggcaatgttgcagatagtggctgatctgttgctctaatttccagagtatcaacaaaaatgaaatggagcagaactcccagctaatctacagtgggcatagaagtgagaaataaaactttgttttaagcctctgaggtcagaagattgtttattctgatggtgtgactcagcctgtcttgactgaaacaatacatgtattttctcttaaattatagcaatactaaaatgtaaatattgccatctccacttttcaagtgttcagagaaggttaacgacctgccaaagcccataccccttgaagtactcggtcctgtatgaacatcccttgaaacactgggtcccagcataaaatcttgagccctcccagttatccacactcccatcctaatgttgaactgcttatatcctgatgataaacactgttttcaagtcctctcggaccctaatagcccctgatttcaatatttttattttaacattagctcattgaccaaggggcagtcatactaagatcatggtttatcggaggaaccacccctgatatttcaacgtaggttcttttctattttccctaagtgtcggccggtctgagaaataaagggaaagagtacaaaaaatagaaattttaaagctgggtatcaggggagacatcgcatgtcggcaggttccgtgatgccccatgagcagtaaaaccagcaagtttttattagccaattttcaaaggggagggagtgtacgaataggaatgcattcttttcccagggctgttaattattaatattccttactggggaaagaattcagcgatatttctcttacccattttcggtaataagagaaatatggctctgtcctgcccggcccacaggcagctagacttttaaggttatctcccttgttccctgaaaatcgctgttatcctgtttttaaggtgcccagatttcatattgttcaaacacacatgctttacgaacaatttgtgcagttaatgcagtcaacacagggtcctgaggtgacatacatcctcagcttaagaagatgataggattaagagattaaagtaaagacaggcataggaaattataagagtattgattagggaagtgataaatgtccatgaaatcttcacagtttatgttcttctgtcatggcttcagcaggtccctccatttggggtccctgacttcccacaacaatggttacgggtagatgatgttaaagaagaaattattcaatgatgcttgtcaaaggtggtaaggaagattttattcaaggtgggccatgatgatagatgtgaagaccactgcaagggggtcttggactcgacttcaaatgtagcatgggaatttacagccaaggagcagtgtgaggtcagcagatagaaaattaccaagaggaaacatcaggggtaaggggagattctggctaaactggtttaacaggatttttcctgaaggcagaccaggttcctcagacataacctaggagatgctagaggatggggaacctggtttcaagggtgagcagatttcaagggcagggggttctggctaaactgatttagcaaattcttgctaaaacgggaaaatgcagagacaaacatggaaatccaaaagtcaggtccagttgaaaaaagagttcaggggagcctgagtagtttgatcaatgacagaatctttttcagtaaatgttccagaaactagataaagttgtgaacattatagtaaacatttaataggcagcctctgtcttttaaaagtaaaaataaccatgtactttactgtgatgtcaagatatgattatctagtccttaaattctcttaaattttcttccagggcacaaatcacatgcactttgacagggccctgatacatataaaaacaaaaacaaaacagaaaaccaagagatagtgataggttttgaactttttgactattttaaggatatgcatctaacaaatttaagcttctcatttcaaaatgaaagtaacacagtataattgtgttattcacaccataatattagaaggtaaaaaaaatgttaattgatggtacctagacttgagaggtggtgctctgaaaatggcatagaggttgaaatatgtatgaagaacatacttttctttcaatcctatgtgtgcctctgagagtatacaaaactttatttgacagtatcatcaaaagatgtcattgaagttctttgtatttgtgagacgtgaaccaaattactctcctggtccctcagtgacaggctttgcttcctgcatttactgttttccctagcagagcacccacactgctaggctgggccaagaaaagaagacagagatgaaacccaaatcggtcacactgaccacttgttaccccttcctgtcaagagtatagcccaagagggctctgaaatgattggacagaatgaagttttgagattatccatggatttcaattacagtatttgtgctctctgagacccccattactatcaatagttgagagttggaaatattgttgagatttttgagatttatgggattttttcactgggtagctacatccaacttgaagcccacattatcagcacttttctattatctgcaaatgtagtttctaagaaagacgtatgtttgctgtctgcatgactttagaaactgccaactcatcaaaagctacaccatttttagtaagacataaattccacgaggtgtcaaattatttcttgtcaaagtggttggttcattggaaagtccagaagaaaagaaagaaaaagaaatgagtaatacatctcaatggttcaaactgaagcacctttccaagcaattgttaggatcagtgctggcaaaggcttaagaggtcacagagaagaacacatttggagtatttttacggtttttaaaataccattaaaataatgaagattaatatttaaaacattttataaatataaatgtatataaaataaaaatatttaataaaatattaaaatactagtatactagtagtataggttattgaaagaagaaatttgacaaggagcactcaggagacatcattgctgtccagtgggaagtaggcatgtgaaaagtataattcatctcccatttgttgctcacttccaagactggctctcttattttctcttttgaaaagtcagagagggccgggcgcagtggctcacacctgtaattccagcactttgggaggccaaagcgggtggatcacgaagtcaggagatcgagaccatcctggctaacaaggtgaaaccccgtctctactaaaaatacaaaaattagctgggcgtggtggcgggtgcctgtagtcccagctactcaggaggctgaggcaggagaatggcgtgaacccgggaggtggagcttgcagtgagccgagatagcaccactgcactccagcctgggcaagagagtgagactctgtctcaaaaaagaaaaggaaaattcagagagagagattctttgagacattggaagctccactggcctactgggtcagaccactggctttgatgttagataacttgtattcaaattctgattctggtatgtattaattacacaaccttgtaccagtgatgggctgtctaagcttcagttttcttatctgcaaaatggagataacaacagaatctatagggacactgaaggattgaactttaaaagcacatctacagctccacttaagaacatgatggaagtaattgcttagtatcttgactgtggtggtgatacagtttggctgtgtccccatccaaatctcaccttgaattataatcatcctcatgtgtcaagggcaggccaggtgaagataattgaatcatggggacagtttctcctatactgttctcatggtagtgaataagtctcacaaaatatgatggtttcataaagggaagttttcctgcacaagctctcttgcctgctgccatgcaagacatgactttgattctcattcaccttctgccatgattgggaagcctccccagccatgtggaactgtgagtcaattaaacctcttttctttataaattacccagtcttagctatctctttattagcagcatgagaacagactaatacagtaaactggtactggtagagtggggtgctgctctaaagataccccaaaatgtggaagctaatttggaactgggtaacaggcagaggttggaacagtttagaggactcagaagaagacagaaaaatgtggggaaagtctggaacttcctagagacttgttgaatgtctttgcataaaatgctgatagtgatatggacattaaagttcaggagatgagaaaattgttgggaactggagcaaaggtggctcttgctatgttttagcaaagacactagtggcattttgcccctgccctagagatttgtggaactttgaacttgagggagttaatttagggcatctggcaaaagaaatttctaagcagcaatgcattcaagaggtgatttaggtgctgttaaaagcattctgttttaaaagggaaacagagcataaaagttcggaaaatttgcagcctgacgatgcaatagaaaagcccactttctgaggagaaattcaagatggctgtggaaatttgcataagtaacaaggagtcaaatgttaatcaccaagacaaaggggaaaatgtctccaggtcatgtctgagacccttggcagcccctaccaccacagacctggaagcctaggagggaaaaatgtttcctggcgtggatccagggttccccatctgtgtgccacctcaggacttggtgccctgcatccaagactctccagccatggctaaaaggggccaacgtacagctcaggccatggcttcagagggtgcaagtccaagccttggcagcttccatgtggtattgagtctgcaggtgcacagaagtcaagaattgagatttggggacctccacctagatttcagaggatgtatggaaatgtctgaatgtccaggcagaagtttgctgcaggggcagggccctcatggagaacctctgctagggcagtgcagaagggaagtgtgaggtacgagcccccacacagagtccccactggggtactgcctagtggggctgtgagaagagggcaaaccatccttcagaccccaaaatggtagatccactgatgacttgcaccatgcacctagaaaagccacagacactcaacatcagtctgtgaaagcatccaggagggagctgcaccctgaaaaaccagaggggtggagctgcccaaggccatgggaggccacttcttgtatcagcatgccctggatgtgagaacttggagtccgacgttcaagggcaagaagcatccagcatgagagaaaaatggaggccagaagacttagccagtccagtgtttctatgactctctgcctgcttttatcctagccatgctggctgctgattagatggtgcccacccaaattgagggtggatctgtgtctcccagttcactgacacaaatattaatctcctttggtgacaccctcacagacacaccaaggaacaatactttgcatccttcaatcctatcaagttgacattcaatattaaccatcacagtgtatgcaaagcactgagacttgggactgttaaggacaaaaactctggagcactatctgagtgtacccccattgtatctaggaagtaactaacttgcttttgattttacagcctcataggtggaagcgacttgcctactctcagatgagactttgcactgtgggcttttgagttaatgctgaaatgagctaagactttaggggattgttgagaagccatgattggttttgaaatgtgaggacatgagatttgggggggaccagtgacagaatgatatggtttgactgtgtccccacccaaatctaatcttgaattgtaataatccccacatgtcaagggtgggttcaagtatagataattgaatcatgggggtggttttccccatactgttctcatgatactaaataagtctcacaagatctgatggttttataaatgggagtttccccatacaaactctcttgcctgccaccatgtaagaagtcactttgctccccattagccttcagccatgattgtgaggcctccccagccatgtggaactgtgagtcaattaagcctctttcctttataaattacccagtcctgtgtatgtctttattaacagcataagaatggactaatacaggtggtatacacacaagccttctacatgtgacaaagttgtttagaactaaatacacacacacacacacacacacacacacacaaatacacataaaatgggggaaatttgaacaagataagtagattgtatcattatctatatatctatagatatatatctatatactggttgtgatattgtagtttagcaaaatgttatggaaagaaactggataaagggtatataggagttctttctattattttttacaattgcatgtaaatacataattatctcaattaaaaaataaaatgcctataaatcagttagctcaatgtgtggaatatcacatatgcctaataagtgatagcaactttttggagaagtgtctacttgtctaataagttactttgactaatgaagaataaggaatggcacatcattcaagctttaagcagaaatatagaaggcactctagatattttgattagctaaacatttaacacaggaatgacaggcttacatgactggcatgagggctaaggtgggaggagtgaggaaatttttaggagattacttttaagaaatctcgaagtaattgccaacaagttggagtcaatgatcccagctgctttcaagatcaaagtgattgattttcagaggaaaccacaaatggtgaggaaaagcactgcccattacctcagctacttaggaatcttcggtagctcagggaaactgttaacatgaaccagagaataatggcatgtatttcccttccaccttccaaacttcactcaggagcctctcactcactgtagctagggaatctatgaggaataggattctaggatatacagtggtaagcttcttcccattgacctagacgaaatgggaagggtatgatgattgattacagtgattattatgttgtgaattgatgacagacaatccacaacagatagaaaatgaagaatattttgccttgcctctagttgcataacttgctacatgggattcttgtcttaactttccagtctattttttttaagtttatagcgctcatcaccagacaccaaaaatctagtggtcttactagcaggtagcattatttccatcatgaaacttgctgccagagagcaacagccttgttgtttggtttgcatccttcccaaccagaattggtcaaaggtagaatgattacctgagataccaagcctcaggtctctgcagttgtctgccctcataggcccagtgcaggcaaataatgtcatgcaaaggaaatgtttttccaagtcttgatcacttggctttctagtgtgctttctgctcagaaaagactccagaaaggcctttcctatttaaggtagcatgctcactccccatctctagttattccattaactagctttgttgttgtatataatctccaagaggggtgtaacctttgctaacttgttctacactatatccccagggcctaatagtgcctgaaacatggaaagtgctagataaacatttgttgaatgaagaaagttttcaaggagataaaggtcaacatgagcaaagtgaattagctcagaatctagtattaagtgtgtatctgcaagaaaatgtatcacccccccccccaagtaaataaaaagccaagctatcctacttcttgactacagtttaactatcaaataatttcctagacactttacagaactgttgtctaacatcataatactagtatgttattattggtcccatatacagacaatgaaacaaaaattgagtaaatcaaagttactaagattactcaggatataagtctgtatgtttccagagcctttattttcaccactataccaggcttcttcatttctctaaaggggctagaaacaggggttgaaataggaatgaaacacttgtccattcatccattcgagaatctgaagctttgcctggaggccgatttccacacctgtgccccattactaagagctatggtgagttggctctaccatccatagaagcaagccagagctattcagctgtcagaacttgattcaaaagctttggaagttgtctggtagaatctagcagagtcaaactcactaaggtatgaactcaatgtgcagacttggtctctagtaacctgaaatagttcaatgcagtggttgtcaaaagaaccaagtttacgtgagagtatagcaggtgctgcatcttggttttataaatcgttgtaaattatctctctaactatattcccagccatttctattacttctcatggaaagcaaattcaaacaggcgtcatacctgaaaaggcatataagaaattaagacaaagtgagccacacaaatcatcactaatatatggtttctagtacaggaggaaatatagcacaagagagaagcaatgaaaatgacaaagataactttgactaccaggacaaagttcttgtttatcacattagagtggctttgtttttttcagagtggttgtgtttttcctattttatattacaaaagtggagagttcctcacagctgagatgagatgtgctgaactgattagctaagatcgtacttctttatcaaagaagctctggttctttgagttcaccattgatgataaaactgaaaatctctcttgctcagggtcagatgtgaaacgattcctggtcccaatctccagagtcactctttaaatgctggcttctatttttttttaatctcttttttaaattattattattatactttaagctttagggtacatgtgcacaatgtgcaggtttgttacatatgtatacatgtgtcatgttggtgtgctgcacctattaactcatcatttagcattaggtatatctcctaatgctatccctcccccatccccccaccccacaacagtcccctgtgtgtgatgttccccttcctgtctccatgtgttctcactgttcaattcccacctatgagtgagaacatgtcgtgtttggttttttgtccttgtgatggtttactgagaatgatggtttccagcttcatctgtgtccctacaaaggacatgagctcatcattttttatggctgcgtagtattccatggtgtatatgtgccacattttcttaatccagtctatcattgttggacatttgggttggttccaagtctttgctattgtgaatagtgccacagtaaatatacgtgtgcatgtgtctttatagcagcatgatttataatcctttgggtatatacccagtaatgggatggctgggtcaaatggtatttctagttctagatccctgaggaatcgccacactggcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttaatttgcttttctctgatggccagtgatgaggagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagttgagtagattgcaaaaatttcaggacatagacatgggcaaggacttcatgtctaaaacaccgaaagcaatggcaacaaaagccaaaactgacaaataggatctaattaaactaaagagcttctgcacagcaaaagaaactaccatcagagtgtacaggcaacctacagaatgggagaaaatttttgctggcttctaattttaaaggtcctgaccttaagctgttaagtttgagatagccacagtcttcagaaacctgcagccattcaacacagtgagaaaagtgctcgggacctgtcctgtttagtacaaaggttatgaaagggaagcatggaactcaactagtctttaaaaatgcagagatgacattggggattttgaggtgttttacaaacgtgtgaagaattccagtttaaccacctgaaattttacatctatttttacatatctggaagtgtagagtaataatgaatgaatagtttcacatgattaaagaagcctaataattgtcatttttcaagttgacttaaggtggcttcatagatatctatttcttattcaataattgtggctaaaagatatgctgtgacctggggccacacctaaattaaccctgaggattattttctaatacccatccttttacattcataggatttgttaccaggatccaagattatttttaaaggatatatagaacccatttgtaaccagaaaatttttataccaatattagttataactattagtgttttataccaatattatagttattagtaataggatgaaatgagtatgttctatcataatggttaatttttattattttgatcaatgtataacataaatattaaaaggctgctggaatttacacaaggtaaatacacccatgtatccagcactcagatgaagaaacagaacatgatcaacatctcagagacccccatgtgtctcctttcaactgcttcattcccccaaggatatctatcctgacttcaactgctgcattcccccaagggtatctatcctgacttctaacaccatatattagttttgattctttttgaactataaattatacaacacaattatatgttttatatatatagtatatactcttttatatattttaacataatttgtttatgagattcatccatattgttgcatataatagttatttcttttccttctcattactatatagaattccacagaatgagtgtatattttaaaaatttactctacttttgatgggcattcaagtagattccagcttgggactattataaatagtgcttttaaaaaaaaattcttttttgagatggagttttgcttttgtcgcccaggctggagtgcagtggtgcaatctcagctaactgcaacctccacctcccaggtttaagtgattctcttgcctcagcctcccaagtagcggggattataggcatgtgccaacatgcttggctaatttttttttttgtatttgtagtagagatggggtttcactatgttggtcaggctggtctcaacctcctgtcctcaagtcatctgcccaccttagcctcccaaagtgctgggattacaggcgtaaacagtgttcttatagacattctttatgtatcttttggcaaacatatataaatatttctgttggatataagcctaacagtggaatttctgaaaatatatatttttcagctttagaagatatagctagttttccaaagaggttctaccaatacttggtattatcaagtttaggctttgaaaaatacatattattggatatagagaggtaactcattgtcattttaacttgagttttagaatttgagtttagaatgagaggcatggatcatcagtaacacagaaatagttccactaatggcttggaaatcattcccctattcatgagagatttggagcctgtgctttgtccagcagaaaaggggaaagtgttttaaatcatggggtgaaatttagagcaaaaaggactatcagagatcaagactgaagttggtccttggaggtatgggcagacgtattccttgtgattcctgaattctcataggtaacagcagcagcatttactgtctcattaggtattcccaattttgccactctctttgtttaacaaattggaacacagtatggcaagttgacagagttgagaagaattctcagtgatgtgctcaaggcacctgtgcatatttatgtggtctgctcatggtcctcagcaagaaagtcaacaggccctttctaaatgagagatctggaagactttcagcaatctgtttgagataaaacatctaacagcatctatgacataaagtggaaataagaagaaaaaaaacaagtaaaaattactttcagtaaggcttagagtctgcaaaatatgggatcatgtctcaatgaatatttattcaccttccataagaagctaaaagttgaaatagtgactcttcccttacatgctggaatcatttctgtgccatcgtagtttattagctataaaatatgaataatcagtttttgtagattgagcctatcaattctaagacattattgcaagtggtcctcaacttctgttccactttgaaacaactagcaatttataaaatttaacataagaacaacctgaactataacatgtgagtgtacaagaaatcaaaaaatgttatttaaatgaataaatgattatttgaaaaaggtatgtgttgtatatggaaatacccaattctatatttctatattattaaagactccaaaaattaaatcaattttatgaaatattgaaatatcttttagaagtcacatatacatttttatgtcgtatatgtgtgtatatatatatatatacataaaaatatatatctgtaggccaggcgcagtggctcatgcctgtaatcagcactttaggaggccgaggcaagtggatcacgaggtcaagagatcgagaccatcctggccaacatagtgaaaccccatctctactaaaaatacaaaaattaactgggcatggtgacgcgcgcctgtagtcccagccacttaggaggctgagacaggagaatcgcttgaacccaggaggtggaggttgcagtgagccgagattgtgccactgcactccagcctggtgacaaagtgagactccatctcaaaaaaaaaaaaatatatatatatatatatatatgtctgtaccctataaactgtagctccatacacacatatacactaatatattgtctgtacatatatgtgaatacacatatttccactctgtataaataacagctttagacattgtttacatcttgctttttctcacttcttagatcttacagctctttcaatgtcctaaatgcaagacttccagagatcaatgtcagcatgtctctcttattttatgaaatggctacatgagtttacattataggcatctaccatgattcagttgaacagtctcttcctgatggacattttgttattttcttcctattaaagcaatgctgggataaacacaatacttgatatatttatataacatgagactatatttgtaggagagattctggaaaatgtacatgctcaatcagaagggctatgtgaattctgaaggtatttccaacatttttcacactcttttctctgcaggaggctgtgataccagcttcattcaaatcatagggactaagaagaggggaggcataattaaatcagtacaaggagtaatggatggttcataggccagaaaaataaacatatatacatacatgcacacatacacattcatactcatacacacgcatacacacacacacacacaaacacacacatcaccacattagggagaagccctcattttcagctgtgacattagctaacatggtttgagacaagtctttcacttctctaagattggattctctcatttgcataatgaaatacgtggcctaaagcattggctctcaaagtgtggttccatgcaaataacatcagtaagatgtggaaactttttagaaatataaattcttggggttggctgggcgcagtggctcacacctgtaatcctagcactttgggaggccagggcaggtggatcacaaggtcaggaaatcgagaccatcctggctaacacagtgaaaccccatctctactaaaaatacaaaaaaaaaaaaaaaaattagccaggcatgttggcactcacctgtaatcccagctacttgggaggctgaggcaggagaatcgcttgaacctgggaggcggaggttgcagtgaggcaagatcgtgccattgcactccagcctgggtgacagagcgagacttggtctcaaaaaacataaaaaaaagaaaaagaaatgtaaattcttaggatctactcaggaccaactgagtcagaaagtcgtgagtgcagtacggtaatctctgttataacagtgtcttctaggtcattctgaagcatattaagactagagaaccactgaactaaatgatctgtaatatcccttctagtattttatgaacctgtcaaatcctcagaaccctaggtgtctgtttccttctttttagattataaactctttgagagcaaagagtaggccagaaatccagttgtcagtagctattgtttcatacagcaaataatgaaagcgtaagtactataggaatccctgtaagtttggtcactttataaactgatatggtttggctgtgtccccacccaagtctcatcttgaattgtagctcccataattcccatatgttgtgggagggacccagtgagagataattgaattataggggcagtttccctcatactgttctcgtggtagtgaataagtctaaggagataggatggttttataaggggcaacccgttttgcttggttctctcgttctctcttccctgccgtcatgtaagatgtgacttgctcctccttgccttccaccatgattgtgaggccttcccagccatgtggaactgtgaatccattaaacctcttttctttataaattactcagactcaggtatgtctttatcagcagtgtgaaaacaaactaatacaaagactaccatgtttttgaacatacattgttgactttcaatatctcttttactgctggatttgagacttgattctgtgacaacaaagccatgagctctttattcaactcttgactgttatctgacttctgatgttatctggcaccaccagggagatcatctgagaccttactatgacaatggattgggggtctataaacagtgagtgttttaatctattaagtgtctgaagagtattaccacaaacaagtggtgtcttgctcaaactgctaaaactaatacagaccttcattctcagagtcactcatcttgggatctaaaagagtgttagaagaattggatgacgttatatacctcttttggctttcatgacaacacaccctttagaggcagagtttcattccgagctaaattctaccctaactcactacttctccttgaacagcttgcttaacattactgaaactctttctttatctctaaaattagactattaccttacctccaggggtattgagagactctaatttgttaatttatataaagcagattacacaattcctagcacataggcatatatcaatatgtcgtagcttttttaattggtctaagtttttgatcaataatttagagatttgtctctaaatcactgattcagagagagcatttcttaatacgaattccttcattattttcctactaccatggcccagcatctttgactcattcttcttcatttcacactgaaacacagtaatggtcttctagttgcaatcttctcaaattcaccctactagagtaattctcccaagacacaacttttacacagaatctgttactcaagaaaagagatccaaaagacagcatactttcttttttttgttttgttttctgagacggagtctcgctctgtcgcccaggctggagtgcagtggcgcgatcttgactcactgcaagctctgcctcccgggttcatgccagtgtcctgcctcagcctcctgagtagctgggactacaggcacctgccaccatgcctggctaattttttgtatttttaatagagacggggtttaaccgttttagccaggatggtttcgatctgacctcgtgatccgcccgcctcggcctcccaaagtgctgggattgcaggtgtgaaattcttaaacatttattctgcatttactgggctcctcctgtatatcaggcactgtatttggatattgtagacaccaagaagaaaagaagctggaagcctctgcaaaagagaagcaagttaaccaatgattaccacatggggttggcagtgctgacacagaggaaagaccagggagatgagaatgggtatagaaatcacctagaaaagtaacagagttgtcagtgaaaacttgcaaaaggggataacatttcccctaggtcttaaaagatgaggtagcaggtatccatgagttttgccacacagctttcatttcctacttctcctggtttaaaagtcctgattttcctcaagaagattaattcctctactctcttccttttggtagaactgtctatggacttcacccagcaggctgacattaacatagttctgagccaatttaaacaacacattcttgtagccagggtgatggattcaggcctttcggagctcctggaagccttattgccaccataagtagaaaatctgcctgagatttgagctaacattaggggaagaacagagcaatggagagaaagaaactagattctgttgacatagttgaagcctctggtcctggaagtgcctaaagttagtcctgtccctggactgtttaattcgtggagccactaaattcaacttctttcttaagccagttggggtcagttctgttgtttcttgcaatcaacataggtctttgccagacatagggaagacagatattcccaactaaggaatcagcaaataaaaaggcatgcccttgaaataaaaaggtgcatccaggcctcagcaagtagtctagctcagctatgccacagaatgggagtaaggaagtaacccagcacacactggagacagagaaggcccaactcataaggatcttgcataactttaaaaaatagatatacatgtcaggggtcaataaacattttctgtaaagaacagacatttctggctttgttgaccaagtatggtctctttcaaagctattcaactgtactctcgtagcagggaattaatcatagacaatatgtacccggatctatataatgcttcatggattataaaacccatttacatctttttcattaatccattcagcaaatatttactgaacactctttatgtgctcagttgtagcctctgattaagaagttatatttagcttacccactaccctgctttagagggattttttgtcccagttgtcatgggcagaatgggagaagaagacaaaatacaaatgagcagcaagataatttcagagaatgctagttgcaataaagaagggtagacagggagatgtggttggaagagtcaggggtttattttacctagggtggtttgaaaaatacctccctgaaacagattctgtggggctgatataggtaaacttgtgggagagaagccttcagagcagagggaacagcaagagctaagactttaagaggataatgcctttcacatgtttaaaaaacaggcaaagggccagtgtcactggagcccgaagtttatagaaggaaacaataggaggttgaggccaagtcacttatagctctttagactgaggtatgaagcttgattttatgccttgggaagccacggaaggattttaagctagggagaaacacaatctgatacgtacattttacaataacactgtccaatgacaatacaatgtgaatcacacatgtgactctacattttctagtagccacattcaaaagtaaaaagacacaagtaaacttaattttcatactgctttactccaaatgcatccaaattattgtcatttcaacatgtaatcaatataaaaattattaacgagttattttacattctttcttctttgtactaaatcttaaaattcagtgtatattttagacttatagcgtatctcatttggaaccagccacctttccagggctcagaaggcactctgcctagtggttaccatgttgaacagcatagttttagaaagatcactgtgactactgagtagggaatggaatatctagagcaagagtggaagcaagggaaacagttattggctattgcagcggtctaggtgaaaggggatgagccagggtaagagtagcagagaggaattaatttgggatgtgtcagggaggtaagatgcaatgcattggattggtgggtgaggtgaaaaaaggaatagaagctgatttctggaggttggcatgagcaactaggttgttggttctattttctgaatgatcaaagcctaggagagaaagaagctgggcagaagcagaatgaggagtttgggtttagatatatcaagttcaagatgcctattaagcaaccaggaaggcagttaaatggagtgattctgtcccaaggatccatcattaatcctagaggcagaagtagtttctcatatttcaaaatctttgaaaaagcaagttttaatcttcatacacttggcccacattctccccttctacttactcctctccctttttctaaagagattgatttcactttccatgagatgctacagtattttcagtttaaatagaaactttaaataaattggatttaaaatcttctcagggaaaagggaaacaatttgtttgctggggtttaatttcaaggcaagagtcataatcaaggctattttaacccatcctttgattaccttcatggcaacacatgctcttgcaaagataggaagattattagaattttaaggaggtggatgtggctgtatctacacacaaagtagcaatgaaaaggttcatgggttgcagtctccagcctctggggcctctaatccacccagaacaaataactgtcttttctcttaacaattgccgcagctacaggctacaaaatctctcttggtggtcaactgcactaccttatcacacacaagggtaaatgttgtcaacctgccagctggctttgccagatgtctaactgattccagccatttgttttcaaaacaacccacttgtttgtgctaagttgctctaccccaacccacactacatgtgttaacagtggcctaaataaatctgtgtttttgttgtactttgccactggcttacttagagaatcaggaaaagtccatcattttttgcctctactgacaaagtcagaatttagatgagtgtacctgatgaaatttttctgagccactccttatgcaatattgaaacccaagtttactcaccgtatttaccagaaagcatctaaggtatttcaattcctctatttcctttgacactccaataaatgtaagcaaattgtagttactataaaagtccttgcatatacctggtaaagaattctatattcagtcaattaaattcaaatgcccagttatttataccaatagatgattcagaccctctcactggctacttgcctgatggtagttcaccactgatttgcaccttgaactataatttctaggaaattttaaatactaaaatgtacattttgctatagtaaaaagccagtaagcatttaagaggaaagtttgggatcattgactatctctccagtcactgcttttaaacatttaatctgtaattcactgaaggtcagtaaaatggagaactttccttcactgataattttatttttttaaaatgtgttctcactatcacctaggctggagtgcagtggtgtgatcatggctcactgcagcttcgacctcctgggctcaagcagctcctgagtgagtagcctccattcctggctaaatttttatttttattttattttattttattttattttgttttattttattttattttattttattttattttattttattttggtagagatagggtctcaataagttgcccaggctgatctcaaacttctgggctcaagccatcctcagcctcccaaagtgctgagattacagatgtgggccaccagcccgataaattcttattaaacagatttcagcagcctgaacaactagttactaaattaaaaaaaagccatatacaggattgtttttgctttgcttgcttatctggccactccctgtggtctgaaacatgaccatgttcacaaattcaggccgtctacctggaccttggtcgttcccatttgcagcacctgatctgtaccatgcctccaacatgagaaaagcttagactttgaacacaaacagaaatgggttcaaatctcagccttaccagttgctagcactgtgatttgtggaacgctctttgatctaagactgtttcctcatatataaaatgaagatgataactcatctttctaacagggtagttgaaagagataatgcattgtactcaccaatacaagacatatagcaaagcatttcgtaatgacgacctctgggtctgcgaaaagaacccttgtttgatggtgtcaatgcagcattatttatcattaaaaaggtaagcattcagttaattacctggatgtcttgatatctgggcacatacacaactgagctacccacttctcattcaatatcttagcattttgtcctaatcagtgttttctacatttcgggggcagtttggtatcaccctatgtgttattggtatgctcatttttaaaacaatttaaaaccatttaaaatgtgagtttattgtgatgtttcattgccagtaagttttgacaacaaaataaagataaaatgaaatcaaataccagaaataacagtaattttatcctttgagatccgatgaatccaagccagatcattcttaaacttatgaaaagatgggaaatgttatgatggtccagagagcgtttgaaacatcagaatttaattgcaaataagagagaatgtcaattgtctagaaatgtgacttaatccaaaatattataatgtcagggaagctttgtggaaacttgatagtacttgatagcaaaattcggatggttctaattacagtcagaaaccagcatcatcttttttataacacactgtaaatttcttttattatttaaaagctctagatttgacaaaagaaaagaatagccaagttcatcatttcttaatttttcacagcaagttaattatgttttatgattcataagtcatcgcatatttgtaaagatggaagtgtgtgtttatttctacaaatgttaaaatttctatgactgttggccaggcgtggtagcttacacctgtaatcctagcactttgggaggccgaggcgggcggatcacaaggtcaggagatcgagaccatcctggctaacacggtgaaaccctgtctctactaaaaatacagaaaaaaaaattagctgggcgtggtggcaggtgcctgtagtcctagctactcgggagggtgaggcaggagaacggtgtgaacctgggaggtggagcttgcagtgagccgagatcgcgccactgcactccagcctgggggacagagcgaaactctgtctcaaaaaaaaaaaaaaaaaattctgtgagtggtgagtgttaaactgttctctgtaccaaaagaaaaaaaaaaaaggtgaagtgataaattacacattcatcatattgaaacatttagagtgttgtagatgtttttgcttgttctttttattggcatgtattggagggttttacagaaagaagccgctacgtgatctggcatctacaggttgcagtaagtagcacaaatttcttctttacagatgcccccacatagcaataagcatagtgtcagtagagacagataaaaccatatttcagcacctactagtatgcgtatgtattagccagggttctctagaaggacagaactaataggatagatgtatacgtaaaggggagtttattaaggagtattgactcacacaatcacaaggtgatgtcccacaataggccgtctgcaagctgaggaacaaggaagccagtcagagtcccaaagctgaagaacttggagtccgatgttcaagggcaggaagcatgcagcatgggagaaagacgtaggccagaaaattaggccagtctaatattttcacgttcttctgtctgcttttattctagccacgctggcagctgattagatggtgcccactcagattgagggtgggtctaccttcagtccactgactcaaatgttaatcttcttttgcaacatcctcaggggaacaatactttgcatccttcaatacaatcaagttgacacgcaatattaaccatcacagtgtacaaaaagcactgagacttgggactcttaaggaccaaaactctggagtcctatttgggttcaagtccaggatctgcttttgatcttgagaaaattcctcaaattccctaggcttcaatttttccatctgcataatggcaataagatacctgcaccacagggttttgtaaatattaaatgagatgataaatagaagattattagtgtacagcctgcaatatgatgagtgctcaatatatggcattgttgtctcatttttattagtagtggaattaaagctgttggtgttgattgattgtgttattttgggaaagctgtttaatttttctgtgcctcattttcctcatctctaaaatggaatcacctcatagggttattatgaggattaagtgaacatgtggctctgttataactggcaccaccaacagaaccgacatttattatgcacttacagatctgacaggctctgagctaagtgctttattttcagaatctcatttaatcctgacaactttcatattattatcctcatttggaacataagaaaactgagactaagaaaaattgagctaatgtcacaagtcacatagctagtaaggcagaagagttgcagtttttaactcatgcatatccaactcaaaggctttgcttttcatcattttgtcataataccaggatttgcagactcagattgctttgcacctaggaaggtaaatgtaatgaataaaaatgggaactatagcaacttaggagaagcgtgcctcatgcaaaaggagtagcgaatacctatcatcaccatgaaggaatgaggagccaatgctaccaattctatggtctaccaagaaaagtctgaaagccatattttgatatgaaattttttcattattaaatgtttaaagctaatttaatttaatttttaagcactgtgatgaccaaataaaatatatctgtaggccaaactctatttgcaagttgattttcaatgttcactctgtattgttctctagaaaagcatttcccatactgtggtccgtagacccccggtgtttttctatgactcatttagggtcgtgttcaaaattattttcagaaaataataaaacattcttctttttcactgtgttgacatttgcattaatgctacaaaagcgatgataagtagtactgctgtttccttagcacaaaatcaaggcagtggcaccaaaatatactagtagccattgttttatttgctgccatatgcacatggtaaaataaaagaatggccattttcttaaaaatgttattaagaaaccagtgaaaagttattaattttatttaatctaaactcttgagcacatgtaatatttcatgtgacaaaatggcaagtacatatattgtgattgtgaatcaaatggccagctggatgagccatcttttttacttaaatgaaaaattgacaaactatggttattcagacttggtattttgcaacccttttgtgaaacaaaacaaaataaaaagtgagactatcacttccaaggaaaataaccaatagcatttgttgccaatgatagagctcaagctttcaagtgaaaaattcaaattttgggaaattttagcttgacagatttccaatacttatggacttttctgatgttattggtaatgatatttaaaaaccactacttttattagacagtgaaatatttcaacatttcaaaagtctgcttaattcagtgaaccaatattttccagtgaatagttcatcatattacaaaatcttgcatggatataagaccactcacaggagaagacagaccagtggattttcaggtagccattgataaggtttcagagaaatattgcaactaaattttaagaaactactatattttgagcttttaatacgaaagaaaaatatccatgattatcttaaaagactgttataatcctataatattatcatatcatataacatttccccattttccagctgcatatctatgtaagggcaaattttctttatatgcttcaagcaagacaacatatcataaaagtttggatacagaagaacagagtgaaactaaaactttcttctattaagctagacatttaagagatttaaaaatcataaaataagccactcttcttgctaattttttttgttttggaaaatatagttatttttgtttaaaatatgccatttacattaacatgtgaggtttattgttaaataaattttaaaatatttttaatttttcacttttaatttctaatgcagtaaatatcaacagatatcaatagatgaacaaagttatttagaatcctctacaattttttcttttttttcttttttttttgtgggggggacagggtcttactctgtcaacccaggctggagtgcagtaatgcaattacagatcactacagccggacctcccaggctcaagcaatcctcccacctcaaccccccgagttgctggaactatgggtgtacactgccacacccagctaagttttgtactttttatagagatgggattttatcctcttgcccaggctggtcttaaactcccaggctcaagcgatcctcctgcctcggccttctaaagtgctaggattacaggcatgacccactgcagctggcctcctccacaatttttaagagtagaaagggatccagccatcccattactgggtatatacccaaaggattataaaacatgctgctgtaaagacacatgcacacgtatgtttattgcagcactattcacaatagcaaagacttggaaccaacccaaatgtccaacaatgatagactggattaagaaaagatggcacatatacaccatggaatactatgtagccataaaaaatgatgagttcatgtcctttgtagggacatggatgaaattggaaatcatcattctcagtaaactatcgccaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgttaaatcacaagttaatgggtgcagcacaccaacatggcacatgtatacatatgtaactaacctgcacattgtgcacatgtaccctaaaacttaaagtataataaataaataaattttaaaaaagagtggaaagggatcctgaaaccaaattgtctgataaccactactctggaatagtgctacccaacgtcatgtttatggatgggcactgtcagcacaacatgggaaatagttaaaaatataatttctcagcccctactctagacctaccaaatcagaatctctgcctgtatgtcccagaaatctgcatcttaacaagacttccagataattctgaagcccaccaaagacagaggagctctgttctacatcaaactgtatcgatgacctacctcaatagtaaaaaacatttaagaatatgccctcgatttatgtgtacttatttccttagtctacgtacaagcagttctgtacttacatattatgatcagtacataaaaaattaaaacatgcaccaaaaaaatagaaattagcggatatttgctgttgtgtacaatgcacctctatatggagactggtccttgtgggtccctggttataattgcattgctccataaaaggattaaaaacgctgtagaaactccctttcccactgtgattaagtcttgataaattaagcagaattgccttcttatggacccattctatttcaaccagtggttgtttttttgtttttttttgcatcaagtactttccaaaatactcagtggaggcttcggtatcactgagactttcttttataaaagttaaggcagcaaagcctagggaaatccgacttcagagagaatttctgagggagctgcttctctgatattctccattccctcatttctccctgaattcatctgatctctccatgagtgaaagaagaaaccaatgaatgaatcagaaaggagtgcttgcccaacttctctgttgttttattgtagtctttgattcatgactttatggatgagtttttaatgctgaagtttcaagataagtatctctggagtttgatagtttgcttgcagtgtttctatatttattttgtagaaaaaaacagaacatcaagaataagcaaggttttgtagtttttttcttcttcttcttcttggaaggaaaagctttaaaaaaactaccgtgggaagacattttcaccttcaaaatctctgtgagttcagcattaaaggagaaagcacttgattaagccatgtaaaaggtctatttcctacattagtctgattagaaggatgagctggggcagtttttgaatatacagatttcttggctccatccaagatgtgctaaatataatctttagggaaaagaaccagaaaattcttttttcttattttttattgtaaaatacacataccatagtacttaccatcttagccatttttaagtgtacagtttagtagcattaagtacattcatattgttgtgcaaatcatctccagaactcttctcatcttgcaatagtaaatatccatactttttaaacaacaactccccttttctccctcttcctcgtctcagcaaccaccattctacttctgtctccatgaacttgactactgaaagtagtcaaatataagcggaatcatactgtatttttccttgtatgtctggcttatttcacttagcataaagtcctcaaggtatatctatgttgcggcatgggttggaatttcctttttaaagctaaataatattttattgtatatatacactacattttgtttttctattcattgttgatggacacttgggttgctactaccttgtggctactgtaaataatgctgctatgcacatgggtgcacaaatgtctcttagaatccctgatttaaatttgtttggatatattcccagaattgaaattgctggatcatacagtaattttaattctttgaggaacctccataactgttttccacagcaggtgtcctattttacattcacaccaacagtgaacaagggtttcaatttctatacatcctcaccaacacttgttatttattttttatagtagccatcctaatggatgtaagaggaaatttggttttttaaacaaatagcttaggtgatttctatgatcaagcacattctagacaatgaatgatcagaaaatttaaaaagaaattgaaggctgatgaaacattacttttataagtttatgacgttttcctgccccattccctggaggcttcatgcacagtggggtgagacagcatctggaatttgtattgaccctttcccagaaatgccaaatggtgtgttgatttggagcttccaattcagaatctgataaccaggagtttattcagtctctgatcttacttgctgtgcttgctgtataatcatggtcttaatctttctaagtttgagtttcttgaaaattaggactaatgatatcaatttcccagggttgtttgtaagggttaaacataacaccacacctgaagtttatttgtttaattttttttgagacagagtctcgctctgtcacccaagctggcgtgcagtggcacaatctcggctcactgcagcctccacctcctgggctcaagtgattctcctgcctcagcctcccgagtagctgggattacaggtgcacatcaccacacctggctaattggtataagttttagacctgtcacttaaaaccttggtgatcaggatcttaacattgataagcccattttcttctctgtaaaatagggatagtaacaagaactgtctggttcctagtgtgctagttgatatctggtatcattctcctcttttttctctgtaggataacccagatgttatgctgaatatcaaatttcacagctgaaaaatatatatcccaatctccctcacaggcaggtgtggcctgaaagttctagatcttaataagcctcccagagaactttcctcctgcctatcatttgctggtaaaaatgcagatgtgaagactccagtagtcatcttggttcatgtagtactcttgaaaatggaagtcacacatgatgaattaattcctaatgatacctcacaagctctgggctgattattttttatcattttctttagaagaaaattaaactatttttaagcctctgttatttctgcactaacagcttaatgcaattcctaattgacacactacctcatagggttattataaggataagattagataaaacatacaatgcacttaaaatagtgcctggcacaaataatgtgctttaaaaatgatcaattttgtttaaacttggcttggattccataggacgttaacaaaaagatcaggctgaaagtctagattcttctctgtactgtggacaacatggttatcaatgagattaagagacaactagagtaaaaacaaaagaaaagaaaagaaaagaaaacaacagaagctctattaactgacctctaaccaatacaacaggttaactgatgttctccattctgtatataaaaatcccagtggacacccacaacacaggcttcaggcttgtaggacactttctagttcatctgagcacttttgttctcagcagttgagctgtatacttagcaacatttggtgcttccaaacccatttgtgcctgtagcacttactattgaaatacataatttaattaaatattatataaaggaatggaatacgagttggacaagaaaaagagttaaatctgaaggttaggtaaaaagagcaacttcttttctctgttttgcaggttggcaaaatcatttaaaaacaattggaagtattatatgttctgcattaagttgtcattttacttaaaaactaggcatcaaagatgatgcataataaatttagtgtatgcaagaatgactgcttgggacctcaatatatgaattcttaatccaaggaaagtccttggccttacatttaaaagtcggcaaataagtgtacgtttcattgattttagttagactgaaatgtatacaagatgcgtggatcaagttgtcatttattgcttccaccgagttttccaactaacctaccaactaactttcttgatcattttgaatgatctacagtccacactgctgcaggcatggcccgaggacaggtatctaaaacaactcaggtttgattgtgagggtggagaaagacacatgctctccaggctcacatgtggatcaagaaagaaaggaaaccaagaaaggaatttacatgaaagcaagttaggcaatgccaaacttccttcacaggcttaaaaggaaaagtgatctgtgcagatagtgatttcagaagcgtcctttgaagtgcttctgtttattctgcaggattttctcacttgcctcttgaaataacaacgatagtgaaccttctttccctgaagcaaaaaaaaaaaaaaaaaaaaaaaaaaaaagacaaacaacagaccttctcaaatcaaatatcactgtgtctgtggtttggctaaaggataccaaaagttgttccctagtgagacatgcaaggagggtagcaaggcctacccttttacgcagaaagatcagcgttaacgagaatcagttgtaaatgtgaataaattaggaaaacagccaggatattgtggtagatagttgccaagatggccttccagaagatgctgtttctaatattgagtagttgactgtaattcctctccccttcaacctgggctgtcctgagtgcttccttgaccaataaaatgttagagaagtctgaacttccaagactaggtcgtatgaaatcttgcagcttcctttagtatcttgcaatggtccctatgggctgtttcttgtcaaaagctagtctcaatgctctgagaagcccaagccacctggagatgttacgtgtaggttctccagttaacagacttaatgggctttcaggcaacagcagcatcaactgccagtcctacaagtaagccatcttagatgtgtccatccagcccagttgaacctttagatgaccaaagatgaaatcaagatactgtgttgttttgagccacctaattttgagtgaaagataactggaacagatgttgtcaagcacagtggttaagaatatgggacccaagtgtcaagactgggttgatgtgagtcctggctctgccgtaattatgcatgtaaatttacacagttccttaacccttctgtgtcattttcttctctatggtgggggtgataccattacctatatcatggggtggtccttaggacaacatatgattatactgcatataaataatataacatacagtaagattctatccccacaacaccatcatcatcatcattactattaccatcaatgctactgctactgctgttgttacttcttgtcagcttttagtagagagagagagacctttgaactgccttcatgaaaaagcccagtggaaaaaagaaaatggccacttggtacagtgcttagaatgatgccttgtacattgtaagtgtttggcatgtattagacatgattataataccaccttttttctgattgccaatgtccttggctaaactatttcagtactctaccagctaatcatgctttcaagatatgttctagatgctttatcatctctaaggcagtggttctaagaattaacccaactttaattctttaacatatgtccactcattcattaatgcattctggttagtaggccactggaatgtcagcaacatggcagacattatgatagataatagcaatatggcaaggctggtaggaagatatttaaaaggtaattgttagaagagcaagacacacctatgactgtgcacattacaataatctaatgtggtctaagattgagaggtatcaagaaactctttcctagccaagctaagacataaaggaaggatgagtagaaatatgtcagttgggagggtggaagggtgggaggttggtaatgtgcctggcagaagaatcagcctgagcaaatgtcctaagctaggaaacagcctggttccttccaggaaacaaaagtagacagagtgtgctgaatgggaaatgatcttgcaaggagcctgaaatgacaagtggagtactcacaaaggaccttccacaatcagaggaggatcctgactttatcctatttggatatataataaagtctttgcagtagcggaatgacacaggcagaatggttttgtgtttgttcatttgtttcttagtacagctttgactgctgtgcatagaaatagctgtagcccaggtggaagaggataatagcttgcccttgggagtgatggcatggatagagaaaaatgctcagcagtcattgctacaggaaaattatctccacctggtaacccactaattgaactttttccaaaggatccacttggatctgatgctactctggggagaataggtgacttccattactaactctttgcttgatactaagtacattctttaccaacgtagcttgaggcacttggtattgtcaaatagttaagagattctagatcagagtttgatcctagctgggcaattactggttgttgtataaccttttgcttctttttcctcatctgtcaaatgggcataaggatagtgtctacctcatgaagttgcaatgaggatgaaaagtgtgaaaagtatttataatagcacctggaatggagaaagtcctcaataattattatattattttgtaatcatttaatccacacatatgtattgagccaggcactggggatgcaaagatgaattagtcaatgtccccactctcaaagatacacctaggaggcagggttataaatcagagattaaacgtaagctgggggctaagaacaatgccacagctgtgcaaaatatgaataccaaattacaaaagcatattgttgctaagtgggtctgagtatctgcatttccttaaagcagagaaatttattattttaaggaaaaaagaccatgtctgaccttggctgaaaacatggtaattacagagcccaagatgtcactgaaaatgcaagacagcttgagggcacaaagatagttttccttcgaaggctgattcaagtagaggattagaagaaggctatttgggattataaaaattcctcccaaagccgtttggtggctttttttttttttttttttttttttttttttttttgagagagagagagaaaactattttagtggccaccatgtagaaagaaacatttgaagtaattcttgtgtatagagggttggctgccagcgtgattgactaaaatggtcttcagggactttcatgagtaaaggagatatattttttaacacttactgggaaatggagctttgaaagcctgtctccagcaaaagggatttttgacatgtataggctggggcctagaagtaaattttctctctcctacttttgcaacagtcttttccctttatcctggtagaaactaaagtagtcaacttcttgtcattaaaatggaactggagaaatcatcaaagagatacgatttttccttactcttttaaagcagcctaggtattaaaatatcttctgagatctgtgcagaattttcatttatactaaacaactcattttgtttgtcagggacaaactaatatgaataacaaatatctagggtagaatttttcatagaaactctttatatgttaaaagaaaaaaaaaagctacttactgcttattgatgcattcaaatcattcttaagcctgccattgccaaaatggcagactgaaccaaaccttgaattcttagtagagagggtatttttgctttttgtttttgtttattgtttggagctagcttgcttctttgttttctttctttctgtgttcctttcttttttttttttttttttgagaagacatgctacaaactaaaatttctgaattcacgttttaaatgtagatcataaatatcttcaatttaaccatgaaaaggtaagctaaaatacactttattttatgtatttatttatcttatgggcgagggccaggctgtgagccagtgtgtggtgagtgaaccccaccaaaaacacattttaaagttctagtagaactaaggtattatttgataaaaccccattagttttatagtagcagaaataaacgtatgaataatggaggtgatttttctaatatctcacaggtagttattagaagcaaagggcagttttgaaaatgtatgtctgtcaagattctcttggttatcagtgacagaaaacccaattcaaactgaatttttttttcttttcctttttttttttttttttaagaagcaggaaggaattgtagtcttatattcaagtaaagtccagggataaagcttattagtgagggaagcagactgcaagtacacgataataaaccacaggttttcttaaggcatagcctcaaatgatgccatctgtgctcagtttccatcccattccatcccatcttttggttgtgccttctactatgttggcttccttcctaggctctttgacatggctctaaacaactccaagctcacattttttctgggtttgagtgccaatggaggaaatctgtctctttaggtgagtcatgggatcagcttggtttgggttaatgggcttggcttaagtcatgttgtgttctaaaccagtgcttttcaaactctccatcatgaaggacctttttattcttcttaaaaaatacccaatctgtcatgggccgatacttttgtaaaatacaataaaaatgaattagcatgaaaataaaatgaaaggacataaaatataagcccaaattctttgtttttagacttctcagacataaaattccctgcccaattgttataaaacttcttaatgtctgtacttgttacagaccagcaataacaaacagataatcaccctttgaggagcagtactctaaactaggagtcagcaagcaacaatccactgactaagtctggtccaccactagtttttaataaagttttattgtaacttagtcacacccatttgtttatatatcatctatgctgcttttgtgatgtcatgacagaattgagtagctgtgacaatgagtatgtgacgtacaaggctgaaatatttattatctggtcttttatggaaaaaaaaaagtttgcctattcctaccctaagcaatcactgtgaccagaagatcacgatttatgattaatcaagatgaaggcacacccccacttcagaagttcatgaacagagagtagaaactagatgattctccaaaggaaattgagattcagctatcaaaagagggggaaaatgggccaggcatggtggctcacacctgtaatcccagcactttgggagcctgaggtgagtaaatcacttgagaccaacctggccaacatgttgaaatcctggctctactaaaaatacaaaaaaaattagccaggcatggtggcaagcgcctatagtcccagctactcgggaggctgaggcacgagaatcacttgaatccaggaggaagaggtcgtagtgagctgagatcatgacactgcaccccagcctgtgtagcagagtgagaccctgtctgaaaaaaaaaaaaaaaaaaaaagggaaaatgttttagggagccaaaaatctgtaaatatctagttccaaacttagatctttttactcttaattctctcatcttttgctgactctattgaaaattgaattactgtataaaatgaatactgcgaagtcaaaccatgccttaagtgaatgcaggtcataaccgaggcttgacagaatttgtcatctcaaatcctttgaggaaaaaagccacggaatatgcaaagcaataaataaataatctgaaaatgttattaaaataagagaattgataatacctaccatgagagtgtataaaataatcatacttataaaatacttacttaactctactttccagaaatggaaatgaaaactatttggaaattatgtttgtttaccaaatatttaatcaatatataccatgaatatctaaacactgtgctaaatgcgggaaccacaagagtgatgacagtggacaggtaagttgcagagagttggaaggatagacaaaactgtggtcagtggataatttacaaactgcaggttataattaggctattatttgaccatagccaaaaggagaagaaatagaaattagtaatgggggaatgaatctcttttagcaaggacagtatccaggagaaagtgatattgaagccatgtcccataagaaagaggaggagcaactagccaacagaagtgtagtttggacacagcatagagacgtgtagtgtggacatgcataggaaaagcaggtgccaaggccctctggcaggaaaatcttgatctcctccaggaaagaaaatcaaagtaagctagaagaaaaataatccaaactatttgggaggttagaaacccaatcattcaagctgggccttagtacatggaaattctttactgatttggcaaagtgagaaaaccttgaagggctttcaagcaagtggaggacgtagtttgatttactttttataatactatttttgctctcttatattaaatgagtaataatcatgatataatggttgcttcatagcaagggcatcattctaagcaatttaaacatattaagttacttaatcttcatagcaaccctataattaattctgttttacagataaggtttataattactctttttattgcttactcagaaaattaaatttgagccttcttgtgctttagaacacacagaaaaaaaaagactttcaccaaacacaaaatagttacttatgaaacctcagctaccatgcccaaatatactattttgggcattaatatcctaattatttcagaccattgatggattactaaaaattgacaaactgggtagaaactgattatttttctggaaacacagatgaatgtagacagtcatactaataatcacagacaatagacaccatgtcaatactaccaatatagcagattatgagaaattagagttatttcagagaggacccagttatttttttctgcttgcctattcccccctgattctccccagccccatgtacttttgatctgccacattcaccttcaccctcccaagtaaaacagctccttcttaatactctgagacacaatatgcaaagagctatggcatcatctataacagttttgaccaggtctgaagattttccccacaaaagacacaaaaccaagcattattctaagattctaaagtattgaagacatgtattcagaccaacactcttacacaaatgttcacagcagcactattcataatccccaaagggtggaaacagcccaaatgcccaccagcgggggaatagctaaacaaaatgtgatgtatccatgcaatggaatattattctgccataaaaaggaatgatgtatagcccaagtatccctaatccaaaaatccataatctgacctactctgaagtttgaagtgttttgagtgccagcatgacagcacaagtggaaagttccatacttgatctcatgtgacaagtcaagtgagtcgaaatgcagatgaacaacacacatagattatttagtgtccccaagggaaaaataaaattaccttcaggctgtgtataaggtgcacataaaacatgcgtaggttttgtgtttggatttaggtcccatccccacagtatctcattatgtatgtacaagtactgcaaaacccaaaaaacctgaaatctgtaacacttcttgtcacaagcatttcaaataagggatacttagcctgcactaaaatgaatgaacttgaaaaacctgctatgtgaatgaagccaggtgcaaaaggccacatattgtatgattccactgatatgaaatgtccagaataggtaaatccatagagatagaaagcaaactagaggtcaataggggctgtgaggagaggaaaatgatgatgcttaattcgaagagggtttccttttgggatcctgaaaatgttctggaattaacttgtggcaatgacttgacattgtgaatatactcaaagccactgatttgtacactttaaaatacttgaagtcatgagttttagttatgtgaattttaccgaatcgttttttgaaaaatcattcctagtagggaggcctttctgatgaaaacctattaagtttccatttctccaggaaagggcatcattttctaataatattttggaaagagagttaatggaacagcattcatagatttatttttatatttgaacaaaatgcttaatgctaagagaatgattaagtaaaaagatgatgataattataatgacaattaccttgatcatcatcattatattatcataatcatataatttggataaacttgggaaccacagaaataattaatccaatgtacacaaactgaattttagtgcatacctaattgactgcttttttggaggattatatatttttaaagcataatatacgtggagaagggacaagaaaaaggctaataatcacattttagtcttatttatgtataaccaaatataaagcaaagggtaaatatttccagccttggagtttgtatgtccccttagtctgtcgtaaacattattccataaggatctttctttcgcataaaacctagtccctcttgcccagctctctgagttgagccacagagaaactgcttgctagacctttgtgttgaaagccagcagggccccttagctgccatcctaacatgaattgctccaagcacaaattgttcccagagcaagcagtatgcatttgcctgcaacggccccatgaggggtctccctagactctggcatgcattcctggagcatcttaactagggctgataccatgatccaagcatgacagccacattgttcctacattgtctgccactggagctttaaattgatttgattagtttcacctggtccacacaggcacacaattgtaagagatctgcagctatccctgtcatgtcactatgtatcaagtgtcctcatatctgactcagccccttaatacagaaaaggaatcctttaccaaatcaaaattgtacctcacctttttcttatcccctcaccacaaatttaccatccaacctcttaacagttaagctaatgagctttaaaatattccccatctgcagcaacaaaaatatcaatgttcagtaaaagtaaaagtctctccaaaagtagtggggccaggtttcaacctgtgctatggtacacagatgtaccatgaccctttcaaagggatcaaagtatgatcaagaatgcaagttattcctgctaaaagtgaggagggtatctactcagaaacaagtttataagaaaaggttgtcagattgtaacatttgtgggcatgcagaatggtaagaacagagtgtgtcttgttgcgagtaggggtgagaagtatggcagcctattaagcagacaccaaagatcaaagcatgtttgctgaaatgtgcaagagctacctcctgagtatgtaaaactgcagccaggtcagtaaattgttctactcaaacagggacaaggtttcggaggataatcaagtggataataataagtaactgtggagagagaaacattttacacttttcaagtgttcaaccaaacacaaaaagttacaaactactgtcctgggaatagtcacatatgatgcaagctgtattcttccaaagtctttagctttttatcttttaacagcttctcttacactcactggcattgtgagcatggttgtaaccttataatcacattatgcaagtttaagggtcacattttaaattcatctctgttactttgtattacttttctatttctgcaaaccacattacacaaatctagcacttaaaacaatgcacattagtaactcaaaatgtttgtgtgtcagaagttcaggaatgtcctagctgaatcctcctctcaatgtcttaccagggtgcaatcagtgccagctgggctgtgttctcatctggaggcttaactatggaagattccatttccaagctccttcaggctgttggcagaaattatttccttgcagatgtatgactggggacccagcttgttcctggctgccagatggagcctgctcaacatcctagaagctacttgcaattccctgccacaagacccctcccacaggcagtttgcaacatggtggtttgcttcttcaaggccagcaagaaaatctctttagtctaccaagaaggagtcttatacaataaaacaatcatgggagtggcattcccatcactagtgccatattctatttctttttttttttattattattatactttaagttctgggatacttgtacaggacatgcaggtttgttacatagatatacatgtgccatgatggtttgctgcacccatcaacccgtcatctacatgaggttatttctcctaatgctatccctcccctacctccccacctcctgataggccccagtgcatgatgttcccccctctgtgtccatgtgttctcatttttcaactcccatttatgagtgagaacatctggtgttgggttttctgttcttgtgttagtttgctgagaatgatagtttccagcttcatccatgtacctgcaaaggacatgaactcatcctttttatagctgcatagtattccatggtgtatatatgccacattttctttatccagtctatcactgatggacatttgggttggttccaagtctttgctattgtgaacacagtggcattcccatcaccagtgccacattctatttcttaaaactgactcacaggtcctgcccacacttaagcagagatgacccaaggacataaatcattaggggtcaccttagggtgtgttcaacacacacacacagagacacacacacacacacagagcaaatatgctttatcagtttacaatccaggtttgttaccaggatctgaaagctggtggaaacactgtgtgggcataatcagggcaacgctgtgctccactggtatgcatttgttatggtctgattggtcaaaatattagtcattgaagcctgataactcaaggtgaaatagctgctctagcattgagaaaatgttaaatatattttaacatatttcatagaagacatttttcctggttgctctagctgagaacctaacaatgcccatttcaacaaatttgtcagatgaaatgttccccaaaatgcccttcttttcaaaatgactaaaatataccctttcatttcatttcatttaaattattctcaaaggcagccacagtgcaaatgaatcagaaatacatattgtatggcaatagaatattctacattatttttctgggctggaagggtgtttattatggcctcacgcaaagcctgtgatgcaggaaggtcttcgatattttaagttctgggccatgcatagcaaattcatagctttcctgctgccgttctgtccttctcaccagggcagacattgataatcaatcacagttctcttgctcgtgaaatctagacacagcttcagaaccttaaacaccatgccttaggcagccactagcaatggctggattagaacttgaattaaacctgctggccagcccttggatagccagttagcttattttaccatagagccaccactgggccctaaaactaaactaaagatgaaattatctgctcaaaagcaaatagaaaacatagactaatggagaaccatgatgagacaggatagggaaagagatccctactactgagacaaaaaatttaaaaggttatattaaaatattatttatttatatggaaaaaatgaaatatattattatgctttttaaattatataacatgattaccaggttgtcagatcagggcaaaaacagttgattaaaactagcgtctagaattcttcaccccttctcccctttgtagtaccttctacctatacttaagctgtgtttgcaatgaagaaacaggtattgttctattaaatgattatggagctcacaagatttttaggctctaaagttgttatattttcaataagacttggtcttgggaagcatcgtagtgtgataaagacatctttgagtcagacacttaggttcttagcatatctcactgtatgattttatgtacacctcttaaccaacccagacccatttctccacatgcaaaatggcaatgaagataaaatacaaaaaccgcacaacccctattgtgcttgggatgatggtgatagtatataacctaagtaatgagaaagtgttttgacctcacaagaaacatgatgtcatgttattacaaagtagtatttatttagatgtcagttctcctttgcaagatataccaaaaaatctaaacacgtgtatttgccagcccatgctgccataacaaaataaccatagactgggcagcttacacacaggaattattttgtcacagttctggaggttagaagtccaagttaagattccagcccattacatttatgatgagggctctcttcttggcttgcagatgtccatcttctcactatggcttcacatggcctttccttggcgtatgcagtaaggtggaagaggagttttctgatgtgttttcttataaggacacttatcctgtcagatcagggccccacccatatgatcttttttttttaaccttaattacttgcttactccaaatgctgccagattggtgattagggctttcacatgtgaatttcaaggggacataaacatgcagtccataactacctgaaaaaaatcttagtgttcagaaagacatcttaggtttgccctaaatcttttacaacagttattgaactttcactgggtgtcaaactcttcgttatcttatttactcttcttagcaactctatgctgtggatactgttagttttcctactttctatatgtttaggaaggtcaagcatcttttccagtgatcacacaactcatgaagtaaccattaattcgttcaacaaagatttttggctcctctgtgctaaaaacaatcctacatatctgagatgcatgcacaaataaggcagaaaaagatcttcatccttgagaaacttacattcttatgagggaaatcagacaaaaataacaccaatagacataatatatacaaaatcaggaaattatagtgcatgaaaaaatatagtagattaaggtagattcgtagtgttggaagaagtagaggcaagtaacaacattaaataaagtggtatagatagagttcatagggcaagtaagagttcagtgatcactagaagaagatgagaaggctggccaagtaaatgcatgagggaagagaattgagacaacagaaggaagaagagcagaggcccaaagatagcatcatggtgtgggtgtgtttgagaaacagcaatgaggccaagagtccaattctggtctgtctaacccaagagtccaacttggtaattgctgtcacattggcctccaagtgttgatgcaccattgtcaatctccagtctctatgataaggaaggaaaattaatattcattgagcacttggtaaatgtcaggcacagtgctaggtacttcatatgtattattggttgtcactttgattaccaaaattgcctggggaaattctgtgtgggttggtcccatggggaaagaaagaatgtatcaagttaattaatgaaatgtcatcagcacatgtggtctcattagagttcgtttcatgtccatcctaccctgcgtcaaggtagagaaaaaagcagctgtggaggtcattgaaggacactgacaagatttccgtcatggtcttgtctgtgtgtatctcctttgcaggcctgtctcctgaaatgcaaaattccactcttccactaggttaggccattatcaagacaaaactaattcttaattttacaggaacaacaaaaaacattcaaaatactatctggattttcatgtaaatcaagtgaaaatagatatgcttatgggcaaggactagtagaagccatgaaaaaaatggaagactttttgaagcatcactgttataatcacaattatttttaaaacccaaagcctcttgaaagggtaacatatcctgtcattaccagccattaccagctatgtaaaggtaatgtattagtttgatccttttcagataccagaactctctctgtttggagagaattacacaagaagagcaaaggaaagtccccagaacagacactgccagggagcagaggatgggaaatgcctcacagggaaatagtttcctgaaagggagaatgaaaaggggctgaagggaactggatccattttgctgaggcaactggctccagagtgggctattaccactaatttatgccctcttgactcaagctaagaaagactcatgttatatgtaacttcccaattttaagtccccattgtctcgggataaagttcaatgccattatcatggcttatcatatccttaatggtctgtccccatctctttgctccatgcttcctctcgggttcaggcatttgcaaagcctcatccctctccctgcagtgctctttcccatcctgctttggatcactgtccactaacataaatcttccttaatcactctcgtaggcagagtctgttacccctcacctctgctaccttagtatccattgctgtctttgcaataggacatattatactcaaccataatgtcctgttaacttggccatctccccattagagcacctcaagggaagggaatggacagggctttggccatcattgtatgtccattgcttaaaggacagaaagtagacatttcagaggtgaggattcaggcccaatcataccatcttgaactacaggaagcacaatgttaactctcccatctcctgaagagcagcctgcatcccttttaaaccagggagccactgtgcatggttgactgggtacagtatcacatttcccagttgcatgttttggggcaaaagcctgagctgtaagtctcggctgcctatgtagccaacagtccacacaatattgctaaataggttatattgcatctaaaacttagaatttacacactttttaggataaactgagactcaaaaaagttgagtgagtcaaatgagtgacatagttaattaacaacagagggcagatgtacactggggaattttgactcccaattcaatttcttcccactgtctcttttgcatagtaaaggtaaaatgaataaaacaaaaataaaaatgcaagaaggtgacaggtttattgggttctgcaaaaaaatgtaacaggaagacataggcaagttaattttcttgtttggctaccaggtaaatgtaagttagaaatgtgtcctctgatataaaccagctcattacattcctaaagattttacacgttttgatttctgtctgttcttgcttattcaaaagtacaggagaaaggtcagatatctattgtattgattttccagagtatacattaaagagactcaaatgcaaatgtgcctctcaactatgctagctattttcttgtccctgaaaggggaaaaaactcattagaacttttgcaatcgtactttatttgctttgcccattcaagattacacccattgctgttttttaaacaaacatatagtataaatatctgggtagcaataaatatggaaataaggctcagccttggtgtgatgaatttaaacatgaagtaacaggtatgaaaacaaatgtgcaaatactactattagcagacgtagttgccataagtgttattaacttaattattttcttagcttcagtagatttctaatcatatatttctactagcagacaagttgaaataaattatttcctctagatcttggctagaattacactggagaaggtaactagttttcttataacaaaacgataaaaacctaaactgtattgaattgagacaatccagtgtgaactgggtaaataccatgaggttttcatgccttaaaatgattctaaggtatatcttactttaaataactacatattaacagcaatttggttgaaaagtagtttaaaattttaacataatataattaaatatagattaatggtcaccaggcttatgatagttgaatgttttcctggtagtcttagttaccacagataaacttaatttcctgattgtaaatctctttattacaactgtcaacatcatttacttattcaaactaaaatcaaatatgttattttaaaattatagtagataaatataagtaatacacaatatttaattagatacttgttgcatacctggaattgttctgcatagtataaatgatgataatggccatcattatcatcaccaataacatagatagcacttacatatgacaagtcctcttctaaggtctttctgtattaactcatttcatatatcattacctcaacaaccctatgagataagaacattatgattatccctatctaataaaaagggcaccaaggtttacagaagttaaatcacttgatcaaggtcccttaaacctagatctcaccaactccagtgataaagttcttaaccacttcacttgcttaaatgcttcacgtgatgcacagaggagtgtaccaataactagacttatcgatttacttactaagttcaatctgtgtctttcatcatttagtggacttttgtatttgcttcccacaatatagaactgagatgcttccaaaatattactctaaaaaatagtaggaattcacttaacagtagaaactattttttcaacacaaagaataatgagccttttaaagtaatgtacttttaaaagaaaatagatgctggtattattagctgtctgcaattttctctacctgccacaaaaaatacagatacagtcctattaccatcttgcatatgtactgattgaagttcatgcaatggcctgtggaaggtccagggccaagagaattggctaataattcttacttcattctgtgctcctgacacaatataaagagcatgttatcttacttaatcagcacaacattgctgctaggtgggttttattccttcattttatgagaaaagagggtaaaagagttctgggtggttttttgctggttttttgtttgtttgtttgtttgtttgtttgtttgtttgtttgtttttaatgtccaggaccttataactactaagtgactaaaagtaggatttaagttaacaaaaaaaaacctgtttcttctggtgtcagaactcatgatcttgattacgttgttacatgaactattaatttaaaccttgagaaagtcctctttagaaaaaaattcacctttggagaactttgtccatctccacctttgtacatttttcaaagcaccagtgttctctcaggcaatttcaacaaccgtgcaaagtgggtggttctacatgtcatggatggaggtccatgttgtgtgtggtagactcactttacagatgagaatctgaggctcattaacatgatgtgattatctggagttctcaccaatatcgatggcaaacatggtatcaatgcccaggtttttttatgattccattccacttttcatccacaggtgcctccagagtggtgaacataagacatgaaaggaagtgaaagtcagatcttctaactcttttaggagtggtgggagtgaaggagtagtgagtttgtgccaagtgatggctaacaaatgccatgtagatagaatgatctgctgtaccagatcgatcaccactgtccaatagtactttctgtagggatggaaatgttctattctgtatcattcaatatggtagccactagccatatgtggctgttttgcacttgaaatgtagctggtatgactgagaaggaactttaattttatttagttttaattaatttaaatttaaatatccacatgtggctagtagttatcttatttgacagccatagtgttagcttttttagcatcaacctcagaagtcatgtccatatcttttctgtggatgtagaccactacctatttcataaagcctgatgcattcaaataagtccctccaaactgtgagccctaacatggttttacttgcctatttcctattgcctcgagaaacactaactcatttaatttaaaaaacaaaaaagactataaagcaggacaggtattacttccattttacagataaagaaagtaaaactcaggtcatcagagtaacttgcccattgagacataagctgatagttttgactaccatactattctgcttatttattttttctcaagtagcttttgatcaaactatacagtttttctttctgtttaggaattgtcttagtttttccagggtaccataacaaaataccaaatggggtggcttataaacaacgtctatttctcacagttgtggaagctggaaagttaaagatcaaggtgctttgcagatttagtgtctggtgagggccacttccccacaggtagctgtcttctctgactttacatggcaaaaggggtgaggaatctctctgggctctcttttataagagcactaatcccatttgcgagggctccatccttatgtcaaaaggccctcctcctaacactatcactttggaggttaggaattcaatgtatgaattctgggggaacataaacatcagtccattgcagaagtatatttggaaagattaaaatggcctttgaactgagagcccttctatatagatatggcaaaatatttttaaatgtggtccttaagcttatcttgttctttttgcatacctccaactttgaaacagtgcctttgacatgaattacaaatatgcataggtatataaatatatatgtgtagagagccttcctttcattgtttgtaaccatttacttctcattttacttttctcccccagtatggcttttcttggtttaaattctttcaggagcaagaaatgccattcaactgatttaaacaaaaagttttctggccatgaaatataaggccaaggcaatgactgacttcagacatcactatctctctctccatctttctattctgttttcttctacattgggttccatctcaaacaagctgtgcctcagtagtaataaaaatgctaccaacaggcctagttttatataacaccagggtaccacccagcaatgaaaaaaaaaaacgttttttcccaatatcattagaaaaaatcctggaattgaaaattattggttggcttaggtcacaagcctatttctgaatcagtcactgtggccaaagagattgttccagtttttagttgtatatgacagccccaaaattagtagtttgaaacaatagccattttattacatctcatgtttttattggtagcaatttggataaggtttggcaggatgattcttcagaataaacaagagatgtaataaaatggctattgtttcaaactactcatggacagaggtccatggtgttcagctggtgactgaattggttgtgaaagttcaaaatggctcatttaccttggcttgaaggagacagctggaaggctgggatcagctgggatgatcaactgtagcatctgcatgtgcacttcccagtatggtagtgtcagggctgtaggatttttttataggctggctcaggactcccagaaataagagtctaaaaagggtgggtggaagctgcaaaacattttatgacttaccttaagaaatcctagaatgttacttgggttacattcatttgttcaagcaagtaactagagccagcccagcttcagcaggagaggaatcatagttctcaaggagaggcatagctatttgttttttccaacagtgtttcagccagaaagagatggatgatctgattggaccagcctggtcatgtggccacctctgtttccaggaagtatggttagctccacctaaagcatctgactaacaccgtagggagagtagctccccaaaggaaaattaaagtattgttcccagaagagaagggagcagatgctaggtatgtagaaataagagctatgtgacaaattgatgttgacatcaccaagcctcatataataattctaacaagcattatgaaatcaaaaaagatatcaaaatgtggggtccataaaagcctgaaccttaaaccttgccattcactagcttgggctaattaaaatctgaaccttaccttccttatgtgtaaaatgtggataataatgatcttcttcccaggattgctgcaagcattagatggagtgctatacacttagggtttactcaacaattatcccctttttttccttatgaaacctcttaaactgtgaacacgagctcctcttgaaattagcaccccctcttagagccacctgaagcatagtagcctaagaagtttcaagtgtgtagaaaccaagcattatttgcaggctgcactggcccttacttcccaaatgcaatttacattttcactttgatcagtaaaagcagatatattggtctctgttcacatgagagagtacctctatgcatctttgcagtgacatactttcctatttcatctttgaaattcatttctctcacaatccaaagcagtcaaggtcactggtcctttaagaatattgtaggttgctcatcccaacccatcttgataatggaatttagggctgaatttagctttttctcttttattggtcatcactgataaaacttgattgcttaatattttttcctgagcatccaggtgctgaaagctgtgttccaaattcagcgattaactgtgtcttaagatactagattgatgacttctcagtctggtgcttttcatcaaggggacagtgtggaaactgagctgtccttcaagaaatgttagccttggtttgtacattttttaatgtgaatgccaactgaaaaaattaggctacatatgttgcagttccttcatattttatagtttcctttgtgtatattttcaattaatgtgcttagttcttgaattggatctaaataaaagtgatcttggattgaaagctatcaggatattgtgcagcattaaggagagcactggttctttctctctcctgctgctagaagaggcaataaaagaacaggagaggaagggaatgtttcgttgtgttcagtgcgtaggggtcataccactgctaaataaaatcatttcagataatagtacaggtgacaccaaatagcaactgaagtacagagtaaataaattgttccttctttttttttgagatggagtcttgctctgtcacccaggctggagtgcaatggagcatctcagctctctgcaacctccacgtcctgggttcaagccattctcctgcctcagtctcccgagtagctgggactacaggcatgcgccaccacacctagctaatttttgtatttttaatagagatagggcttcaccacgctggccagactggtctcaaactcctgacctcaagtgatccgcccacctcggcctcccaaagtgctgggattacagacgtgagccaccgcgcctggccaattgttcctgtttccatttccttctatccttttgctacattgaaggagaaaatctcaatttagtattatcatgtcttcaacacctctcaaaaatatattcatctccaacttcttaaaagaaactgaggatttcaccttaggaagacaatagtgtctaactataatcagtaatctttttattgttgtatttatttttatattgaccgcagagaatgtaataccagttttccacttatagtaaggtaataatgtttcctttttacataaagtcattgaattaaaagaatcagttcctaaaagtgacaccctttgttttagaagtcagatggagctcttttagtcatggccttatgtagtgcctttcaccctggctgcttgtttataaaccaagactacccagtttgtttggtgacctgggtgcagggaaagccgtgcaaatgtgtagtcaagtggtctgtaataagatgagcgatacaaatgctgaacaagcctcctctgggcagcatctgatagatttctgtactgaagaaaatatttgatgaggacagaccccttaatcctgtcaaacgaactaattcattttcagttccatctatgaaattatactccacaaaagcagaactatggcccaggaggagacagtcatctgacagagaaacagcattgctgagatgagatagaacttgctctggatcaaaagtgatcatttctattattctcatggtatctttgatttgtcacagcaattgcatttgtataaggcctagttaattaagactgtggactgtgatcaaatttaagcagcacagttcctaaaatatacccagccttatctgctcccacttgctgataaacacacacacacacacacactcacacacactcgcacacttttgctccagaaatgctgaactaatagttgccagaatacaacattctaactcatacctctgggtcatgcacaagcattacttccactgagattccctttctctactttactgcctttgcaaattcctactgatcctttagcactcattgcagacatccctttttcaacctcctctcaactctggattagatcctgcatcttaatagctgtgtgagcgtgggcatgttatgtagcctccttttgattggtttcctcctctctaaaatgagataatagtagtgcccacatccaagattattatgaggcttaaattatggaatgaatacaattttttttggcacagagcctgatccacagccaattctccctaaattctccctatgatttcaaagtattatttattttgtcattgccctgactacattgattgcaattaaatagtgtcctttattaagctgatagttttttaaggatatgcactgaaatttattaaatttgtcctcagcctcaacatatttaggaatataacatatttatatttaattgaactgcattgaattgcatctggatgagggcaactgatggttactgattagtaattactgatgattacttttataataacaataacaacagcaagtttatggagcacttactttgaactaggcattctgggaatcaaagtccccaaaccaactaattggctgtttcgttcacatctgaacccatcactgagatagggggaatggaacatgtagaggggttaagacaaggtcccatgaccacatggtttgagagagtgagtgaaggttgtttccccaaagataaacccaagtaccacaaccagagggaaaaaaattgggattactgctggggagaccaaaatgtcagatgagtacaacactggtttcagagtaatttttatttgtccataaagcctgcctcttggatcattccagggcaacaacctagcagttaatttaagtgataagattaaagtttattttaaatatcagtgatctttcctccattcccaaacagaatgagttgatacattcgtttatatatatcaaggtggttgagcttgttggtctataatacaatatgtaaaaggctaattagaatattgctactgtggtctgaatgtgtgtgtctcccccaccctcaattcgtatgttaaaacctaatcaccaatgtgatgatattagaagacgagggcctcatgtgagtggaatcctcatgaatgaaattagtgtccctataaaagagactccagtgaactactttgtctctttctgccatgtaaggatacaatgagaagacgtcatctataaacaaggaggcaggccctcacaagacaaagaattggccattgccttgatcttggacttcccagcctccagaattgtgaaaaataaatttctgtcctatataaggtacccagtttatattattttgttataatatcccaaatggacaaagccaattgttaatgattacctcatagttttgtatcaactactttgcctagtatgatgcatttcataaataaattcatatgtatgtgctataggctaccttatccagttcaggctgctgtaacaaagtactatagactgggtgggcttataaacaacagaaacatatttctgacagttctggagtctagaagtctgagaccaagttgccagcatggccaggttctggtgagggccctcttctgggttgtatactcttggcttctaattgtatcctcacatggcagaaagcagagtgaggtttctgggggacccttttatgtgggcactaattccatccatgagggctccactttcatgaccgaattacctcccaaacaccctatctcctaacaccatcatgttgcaggttaggatttcaacatacgattttgggaggacacaaacatttagttcataacatgagcttacatattacctttctgaattgagggggaatgttgttgaagaagagtttcataatgagatgaaatgaaaggaagtaatttgggtgtattccttcttgtaggaaggggatcgtatgaccaacaaaatcctaaaacacaaaacagtttgcctatactcagaatgttgcactggtgattgttttttttctttgggaaaagttgtcgtctcagaaagtaaaatgaaaatggtttttgagcttggcatttgggctagagccaacttgaaaattcagagcatgagaaaaaatttttttctttagacctgtcttctccacaaattatattcacgaagattttcagactctgtccctgtggctcgggctcaagtagagatagatttcagcctgccacaggtaggacagaaaatgattttaaaagaacaataaataaatattagaagccttttctttagttgctattttttccctttttcttttgatggctgatgttcagttttctcccaatttctttcttgtgctacagcaagcctcgaaaaatacttcactataagagcaacttctaaatgctctcgtcttcttgcagaaatcatgtcagaaacatccaaatgaatcttaatagttgagtaaaattgaatttggcttctctaggccataacagttagtattactccattgtgagcagatctggattataattaagaaaacccaacattaccactgacacagaagtatgctaggaaaatgactaatttacatagatctatgcctgttctgtaacttctgcatctggcatgctatgagggacagtgtgatcatgcatgtaaagtggagggacacatgataaggacagaaatctactctcaggattatctattagtcaactaaatttttaatattaatgcaaaatctcattcttcagtaattgttaatattcggtactaaatggctagaaaatagcagcaatctggctttggtgcagtcaaacacctggattcattcaatcatttagttattccacaaatatttattgagcaccttcagtgtagcataggattgtgttaggtggcaagtagcagaatgcccaactgaagcagctttgacaataagaattgattttttcctgcataacagaaagtaaggaggtattggtttttgacataagtgccagccttgcagcaattttcctgaactgtcttttatgatggctatagtagctgcagctgtcatatacgcatttcagactgtgtaagtaggtgacttaaggaccaggccagcagtgactttgtcttttcagcaggaaatcaagacttttccagagcgccctccccagcagacctttgcttgctctcatagaccagaatcgtatcatatgcccaaactcagctaccaggaaagctagtaaagcaattattttgaagttccgctgctggagtgggaagtatcaagggagaaggagttgggaatggcttttctgtagccaatttacaatgctggtcacaatttctatgtgccaggcactctgcttggtgcattaaacacacaactggaaatgtacaatcactggcctcacgaagcgtacagcttagtggagagatagatgaggaaacatttaaaatacgtgaggaaataggagcacaataccatagaagcctaaaagaaggaagacttaagtttggtttagtgtggaattgatcaagaaatttgtacagtatcaaagtataccttagagacagttatttggcatgtggtttatttattcctcatgcaaatgattttcttgtatttgagaaagtcagtggtaaactaaatcaagtaacaatgacacagaactcataagggatagggaaggaaaaaacctatagacagtttgggaaaagtgaaatttgtttgcttatgttgtgacagaaacatagaagtgagtctgggtttttctgtgtttttttctgttttttttttttttttttttggagatagggtctcactctgttacgtaggctgaagtgcagtggcatgatcatgactcactgcagcctcaaatgatcctcctgcctcagcctcctgagtagcaacaacaggagcacaccaccgagcccagctaattttttattttctatttttcatagatggggtctcgctttgttgctcagggtggtctccatctcctggcttcaagcaatcctcccacctcagcttcccaaagtacttggattccaggtgtgagccaccaaaatatcaaaaacttttcagttatttataaatttttctagaatatcctgagattttagctgtggattgaatatgataggctgattttgtgtaatgtcttccagtgtctttctgtctaacttggtgagatctgatataaatcatttcctcactacaaattctcaatgagaacacgtatttggattgagattgtaagatgtcaaaagtctctactcgatgggccagtggaaggagagcagttccagtggtgttagcaacatacataaatgtgcagagaaatgatagggaaaggttcggggagctagatggccattccgatttactgaagcagaaaaagaaaggcttccaagtcttcttctagtcaattggactggtgcttcagaggcagcacctaagtcaggctctgagtacatacataaaaggcacttgaggccaggtacagaggctcatgcctataatcccagcactttgggaggcctaggtgggcagatcacttgagaccaggagttcgagaccagcctggccaacatggtgaaaccccgtttctactaaaaatacaaaaattagccaggcatggcagtgagtgcctgtaatcccagttactctggaggctgaggcaggagaactgcttgaactcaggaggtggagtttgcagtaagccgagatcataccactgtactccagcctgggcgactttgggaggctgaggtgggcaggtcacttgaggtcaggagttcaagaccagcctggccaacatggtgaaaccccaactctactaaaaatacaaaaattggcgaggtatggtggtgtgcacctgtgatctcagctactcaggaggctgaggcaggagaattgcttgaacccgggaggcggaggttgcactgagctgagatcatgccattgcactccagcctgggcagcaagagcgagactccgtctcaaaaaataaataaataaataaagcacttgaaagaagtgtatgtgtgtctatgggatgagtgaatggaatgccagggatgatagggagtggcagggactatggcaaactggagaacatgaaccccacccaaaggagaaaacactgctcagttgtttttataaacacgcagccccagtgttgctagtcttcctatttttcccagaaacctaacatttgtactttaatgtaaaatctcctaatttgaatattggtgattaatttcaattattaaaagtactgtgtagagagaaaaaaagaatccacacttcagtttaagcacataagctgccaacttttgacctttgtgttaaataagtgttttgtaatttcttaggatcaatttgactggagaacaggacatctcctttaatcaggaaagtgagtagtcaatgatcaagaagccatgaaaaaatgccctgtcatcaattgcttgattcttacatcagtgcttttagaagcaaaaactcataaatatagtatctgaatttgattaaaataaaatatcccccaaaatatatatactaaaataacactcttaataactattcagtataatagatcattttcatattcctagtgttttgctatttaagtgtattatggaaaagattgtttttatttttcttttcaaaggcctaggttttctttgcatgtactcttgcttcccagtaaatccaagggcaaaatgcatttatagattggggtttgttgttttggatttaggtgcagaatacccaacattttatgtcatttttttccaaacttctgtcagtctcataccatcttcctatttcgtgctataccagtacattgtctttatcattacttgcttgatgcttttctttaaatttacctaaatgtattcatcttaaaaagatattttctgactactttcccattgccttttgttgtataacaaatctccacacactgaatgacttaaaagaacaaaaatgtaccatttctcacgattctgtgtgttgcctgggtggtttcttctggtctgggctggctccattggacctggaatcagggtggcctctgtcacatgtctgatgattgacaggttgatgatgccaggaggacctcagctggggtagctactctctgctccacatgacttttcagcatggtcacgacaggtttctaaagagcagtaagccccaatacaagcaccttcaaatctcttcttgtctcttgcttgctaaccttttattggatgaaaaaatcatataaccaaacccagatagaagggctggcaaaatagactctacttcttaatgtaaggacaggcaaagtcagtgcacagaggcaggtgtagaagaggaagcatttgtaattgttcttacaatcagaaaatagaaatttagtattacctgacataaagaggcagtacatttagaaaataaaatcaaaatgaattggcattattaaaccactattgctagaaaagtaaggttttaagctaccacaagattccccatctcccaggatcctgagccctcagattgggaagtacttttctatgtttctaggttgttttttgtttttgtttttgtttttgtttttttttgagactgagtctccctctgtcgcccaggctggagtgcagtggtgcgatctcggctcactgcaagctctgcctcccgggttcacaccattctcctgcctcagcctcccgagtagctgggactacaggcgcccgccaccaccccctgctaatttttttgtatttttagtagagacaggatttcacagtgttagccaggatggtctggatctcccgacctcgtgatccgcccacctcagcctcccaaagtgctgggattacaggcgtgagccaacgcgcccggccgtttctaggttttattgttgaactttgggtatgtgttccactcgactttcaatttagctaaatatatagccataaatacagtcaaaagcgtaggggatgtgcagctcaaggcagtagaactaagatgttgaactttttgcaaacagatccatctgaaacattgctgcatgtatattcctggtctcctttgattatttttttagctttcttaatgccatcactgacacgaacaaaatgaatttcgaagcgtcagtatggaattttattttttacccatgtttgttggcagttggcagattcattctggtttagcgggtttgatattagtgaaattacatatttcaaaatataagaatccttatatcatccttcattttctcatctgctttaaaactcataggtgaaggctctgctatgcttttatatagttcagtctgcctattttaagtagtgctgagcatagagcaggtggtctataaatattttttctgataggtaaagctaaattcttccaaatagtccagacaattccacaaaaataaccatgctagttgtgtggtattgtataggaaaacaaagctgttgattgttgttttccactttttaagaggtgaaggtcaaaggcatattccagagatattgggaagttcttgccaaatgactgaagtaatcaactatcaaattattttgccatttcaaatatagacacacatcaaattagtttcaagagtgctctatgattaaggagtccatatttcatcttcacatgagagtctagttatgttttttgaagttaattacagcaaacctgaagatatcagtctcccctagagactgcaagagcacaatggtattatatcctgttattctctctctcttttttttttaatcaaacacctgtattaacacattctcaagtgtctgtgagccaggcaaatagtgctgagaaccacaagcttttcatccagaccttagtcctcctgagttttccatgttctcagttgtgattcactcagccacctatgacagcttaataaaataagagaaacaatgtatctcctttgattccctaggatttggcttctaaggcaataggtgagttcagagttaagagacacttctctcctagttggtatcaatttgtatagatctgaagtggcctaagaggttttgcatgctctgtagtttctcccttgtctaaagtttccatcaatgccaagagcatctccctgggagtttgaacttccctttaatctaatccatttagaaaatgactcacaattcattgaatgaagtagagaaaattgataacttttcattagtctgacaaagtctttttcagtgctggcatctaaaatgtgttctctatttaaattttatttatatcaatcttctctagtgggagtaagattaaaatgaaataccttacaatcagtgtacaactttcccattactgccaaaattgtgaacactagttttgcaaatgaactcaataccaggaattttctgagcataatttaatatttgagatcaactgcacagtggaatcaaccaaaagtgatattttaatacctcaataactataaaaatgattacatataaaaagaggaaagagtacttaactgacattatttgatcatggtaaatttgtagcaattccagcaaaaactatattatagagtctaatagtactctcataatgtactttttaaaactggggaaatgtttgtatataaactcattccttcaaagagccatttctaaagtttaagaaaaataccaaagtgtaaaagaatgcctctgccaaatggaatcatgagtgataattttttaaataattatccatatgctttaaatgttagaaaagaatatgtattactttcagaattagaaaaaaaataaaggttttttaagttggcaaaataagaaacataaaaaacatttgttcttcaacaaaattgcaaattactatccactgtaaataaactttagggtcactcttaaataatttgaaggtagaatgttaaattttaagatacaaggtatatacagtaagacatgtatttaataagcatgattccttgtgttccttgctaaccatttattaaaaattatttttctacacagatgcaaagtcatgtaaagctgaattctaaaataaaaccatctatttagtgaaagcaagaccaacattcaggatttgatttacaaatagaatcagggataaagttaccacagattaaaagtatagaataagccagggactccaggactggtatgcagcctaagacaaagagtattattagtggcaggaattaggagagcttccttgagttgcaaaaggtctctgaaaattccttgtcaccagagcatacagcttttttcaaaataggacatgtacccctgtgttccaataagacagcttagagtagcccataacaggtaaaagatttctaattgttttgtgttttattttaaaattcatgtcaaggtagccttttatatcataatatatacttacttgttttaatacaaaaacagttttgttaattacttaatggttaaattacttcatcaatgaggagtcttcttatggtcacactctgagaatctaaattatatccactagttcttttctctgatagcatgctgtatctttttatgcatcacaacttgtcaatatatattgtctggtctttatatttggtgcagagttccaaaaagagactgtatgctgctttagagtgggaactgtgtgtcttgattttatgtccagcactgcagtaaatgattagcttttgaatgaataaaaaataacttttgtctcaaatacctttaaaaaaaatctaccgactgaaggaaattataccacatttaacttgtgactttcaatcctcccatttcacaatccatgtcctcccctctaccctcaccaagataagattgtctgttcgaaaagcactagaatagaatttgtagagggaatgcaatcctaatgaatcttatcatcagcccttaacttcatgtatgtctttgaaatataatgtagatcctctaaagaaatacaatttgagctgtaaaaaatgatcgtatgcatttcagaattagtataatcttgcattaaagataaggcattaaccctgtatgaaggtgaggggatggatgcatacagagctggataataaacacatggataaataatagtgataactgccacatgctgagtataaagtttattaggcattatggtaagtgccttatctaaaattcacgataaccagttgtgacttttaacttcatctacaactgagaaaacttaatcttgaactaagcaattttccaaagtcatactattacaaagtggtagaactaaaattcaaacccaggtccctctatcgcatacccaagagtttagagtcttagtcaatacataatgtctcaaaattggatcctatccttaaatatgtgctcatagaaaagcgaagtttgaaataactgcagggaaggttatccaatgcctttaatttcctgtttgctttgataaagacaataacacactgggagtcactacaggtcttttgaagaaaagagttgtaacagctgttccaacaaccagtgcaaaaagggaggctggagatctgtcccatccttacagtggagttctagccattgctttaaattgcatgacaggttgcacaaaagtaagtctggagatttgtcttgattgaggtacttataacctacttctgggaacatgaatacaatcatatgttcaaccatttaatttatgctcaaactctcataagtcatagaagcaagctgagagtttggcatatcgaagaataatgttttactctcacttagtgaagaattgcctttttggtttggcatgattttattctttagagtaataaaattgatgatgccaatgaagataatgatagctaatatttattgaagatttactgaatgcccagtactctgctaagtacttcaaatgtactttctcatgtaatcctcacaaccctttgatataggcactattttttttctctttttgtttcattgtgtttattcattcataagttggaaatccatcttgacctaccccatgccactcaaagattagtatagtattaatcctactgttaaggagttcactgcctagtacaagtaggcaagcagatgagtccagtgtgattggagtgaaagctaagatgaccgagttactggttaaagtgttcctctgttattcctaacgttgccctccaccctgcccttcttcacaattctagtgcaagcatgtaaaatcaggagcttatcttttctctttgagtttagtgactcttaactagcatttcatctgcttcttcttccatcttacacactacaccaatgcatcttcccctacctaccctttaatcatatctcccctttgctcatggaatctagattcaccattctctaaaaaaaaaaaaaaaaaaaaaaaaaaaaaagaacacaagctgcttgctttcaagaacttccatagtcttattaagcctttgtcttagtctgcttgtgttactataaaagaatactgcaggctgggtaatttataaataaaaaatatttatttggctcacagttctgctggctggaagactgggcatctggtgaaagcttcaggctgccaccactcatggcagaaggtgaaggggagctgtgtgtgcagagaccacatggcagagaggaagcaagggagagaggagaggtgccaggctcctttaaacaaccagctctcgtgggaactaagagggtgagaattcactcaccctcccctgtaggggaattgacctgttcatgagagatccacccgataactcaaatgcctcccattaggccccatttctaacattggagatcaaatttctacatgaactctggagaggacaaaaaatccaaactacagcaggttttctccttttattccccaacctgagcctgctctattaacacaacatatttactaggggaagagcactttgctcatttatacttctttcctgtaatttatgacaaaatgccagtaacctgtattgagaaactctgatctaaactgtcatctttgaggacaggactatgtcatgttctttattttatcactcttggtaaagcaggtaatgttttgataaacatttgctgaatttgattatctactgaaacagtagaaagggactgcagttcttagtcaatataatgtttatttattgttttcattaagcccattgcttattagtatcttgctatagttccatggcaaaatgcctcatgagtgaacaacaaccataatgaaaaacagatttctgctctatttaggatttatactgaaataaaggattgattctccttttacagcctctcttttgctctatagcaatatgacctagtataagggaaaaatcaagactcatgattaaagaagctttagtgattttaagaatctctcaaagaaagatgaacattctggaaagagttgaagatcaaatattttcctaagcatggcaaattcacagagcaagtcctagaaccccagggttaaaagggaccttaaagatcttctttcataatcacttcagataagagaagctggttttggtggctgatatttaattaactcagttctaggggataaaaagtcctcggagcagttatgcatctacctcacaagtttctcatggcttcgaaaatggttcacttgtgggaatttctattaaaatgctgtaactagtgaaatcaagtaatgagtagctcagatcaaaaaaaaagtgtgataagttggctcttgcttgaattttttttaaagctaacttaattttacaagaatctaaatgtttttgttttctgcaagtatttgtgtttgatatgaaatttattttcgatagtaatacaacatacagaatccatggactcatggactcaaaagccaatatatttttttaattctatgaatgctgaatacaaaactagaaggcactgaattagcattataatgattaacaacaacaacaaaacaaaacaaaacaaaacaaaacaaaacaaaacatggatttggtggggaagcaagctggggttttagtgttaattcctgcacttcctacctgtgtaagcttgggaaagttacttagtctctccgggcttcagtttcatcacttttaaaatgggttagtgataatacctactttatagggttgttaacagcagcgtatccatgtgggtctgcagcagcctcagattctgcctcctcagaagaaagaatttgaccgaatgacttaaagcagagggagagaacaaggcaagttttagagcagaggtgaaagtttatttagaagtttagagcaggaatgaaagcaagtaaagcacacttgaaagagggacaagcgggtgacttgagagatccaagtgcacagtttgacctttgacttggggttttataagttggcttacttctgggtggttgtgtcccatctcccctgattcttcctttagcggggctgtccacatgtgtagtgacccgccagcacttgggaagttgtgctcatgctcatttgaggcatttttcccttatcagttgagtgttcctagaggaaggtcagttaaactccatcattttgcttcttagagcacgtgcttgaacctactcatccaactcctgagatcttatggggaagctgctgatcaccagcttcaggtgttttctatctgttgggagactgcctttccctggcgctggttgtgaccaattattattttagagagacagtttaacaagcacctgaccatcaactgatggttgccaggcattcctggtggggggccctctcctgccctgctcatgtcaacctaactacctgctctaacagagttactgcaaagactgaggtaatacatttaaaatacctaacagagaaacacataggagcactcaataaatgttaattatcctttttattattgcattgactatcttaattcaaaatatttaagaattatttatctttatatttttcttatgcagggttgaggagaattttcttctctctgaacgtccaaatctgtctgttaaaatgaatggacaacagatccacagaggagaaagtaggcaaatttattaacatgtacatagacatgggagtcccacaaatgtgagacccctaaagagctggatgactgaagattttacagcaccctgaggttatagaaagaataggggctcgggtcttcccaggaggaggaggggaggtggtgtcactggttatgggaaaatggcagaggcaaaacctggcaaagaaaggctgccttcttatgcagataaaagcccctcaggtatctgggagcactctcagaaagaataaatggtagcctgtggtaaaagtttctctgtcagactttaaaagtgtcagacattgagtctttttttcggaggggggatggagggtgggcagtgctcagagaaagcccatttgcatccactcttcactaatgtagatttcttgtttagatacaaatcatccccaaaaaacacagcatttcagagccatttctgtgtctacagcccctctgagtagccatctcaaaatataccaaagaagtagttggggagggtgcatatttgggtttccatcacttatcataagtatctccatgagacaaaattgtaaaaacagttaactagcattgatattagctcattttattaaatctagtggatcaattctctttcaataacctgaaggttttcaggtagctttcagtttgggtgaagaggaggcaattttgaaattctctcattgtaaatttttttttaaattgcagaaataaaatgagtttatgaaaaaattatgtttagagaatgtagctttgtaaagcaaaataataataataataataataataataataaaagtctgacataggtctcaatcaatttggaggtttattttgccaatgatgaggacacacctgggaaaaagagacaccagtcaccataggactgtggcctgcactttttccaaagagggtttcgagggcttcagtatttaaaggggaaaagtgggcagggtggtaaggagaacaaaaaaaaaaaaaagaaggaaggtatgtagtaaggtgagcggtcgcatccttatgatgctgtattagtccgttttcacactgctgataaagacatacataggactgggtaatttataaagaagaagaggtttaatagactcacagttccatgtggctggagaggcctcacaatcatggcagaaggtgaaaagcacatcttatatggtgctggacaagaaagaatgagaatcaagcaaaaggggaaatcccttataaaaccatgagatctcatgagacttacttccatgagaacagtatgggggaaaccgcccccatgattcaattatctcccacagggtccctcccatatcacatgggaattatgggacctgtgattccaaatgagatttgggtgggcacacagccaaaccatatcagaggctttagtgagtgatcactaaatctacatgttgcatgtgaaaggagcaggcagaggaacagtaaagtatggattcgccttgtgctttcagtaaaactgcattttacatgagataaagtaaacatagagcagaggaagaagtctaatatgcatttgtcttgaggtggggagaggatcgatttctactcctgtctttgtcctgtacctgtgaagataagctgttaatttacattgtcagagtgagtgagaccatgcagagagacatgtggccttctatcttgcacttatctgtttagaaacaaaggatttgtgtttgtgtgactcagttcgcaagctttacttttccctttggcatagtgagtttgtggtcctgagattttattttcctttcacaccttgacctggaatataaaaggatatatatgaagatggccatgtaacatgtcaatcagaaacaaaattggtctaatgacatcttcagaaaggcaacactgtgaagaaaactaaaatattttacccgtatatatatgtctttgacatactttgagatggttgttcagagggcttataaacagaagtagcccccaaatctgtctctagtggagacgatttgcatctgtagaggaaaaaaaagtgaactaaagaacagatgcaaacagcttttctctgaagcccccaccttgtcagtatttagaaaagattgactgagggtctgacacctggctgttctctctgagggctgctacctgagaagtttcatctgcataacaggaccacctttgctagccaaatttctcttcgccttcttccataacctgttccaagcccctattctttctgtaagctcaagatggcataaaaacatcgataatcttggctttctttgaatttttatattttgaatgattcttttgcacatgtgtgcacataatttgtatgcctttttttcctgttaatgtttatttttattttgttttatagactcaaattagcaaatctgcaggtttaaacttctctacaactggaagaatgaattggattctagtaagccaaagggtaaagcaaatcatccaactctatttagaagaggcaactctaatgtgaatttttagatattataacagttctgaggacgtttttcttcttagaaagcctcttcttttccccctatgaaccagtggatctttacaaccttgaattaaaggtgatgcatgggtttggagatttattttttccctaatgtctacattttcatttaggaggtattaatgcttaagacaaaaggaaactgctttgttaacttgcaacaaagtagatcagctccaagagggcagagagcagcctgaaggaggaggaggaacagggcttagaaggaggcaacaccaaaaaaaaaatgcaaaaagctgaccccactggcggatgtgcattattcgctagcttctgtgaaaaaaagggtgacaaaatgctaagttgaagggttgttgggaaaggcaatttcttctcatgctaagatcaaagggtttccattcttgatggtttagattcagggcaacaatattgaaatattaggtggggtttaagtggataagcatcagaaatggtagtaaatgtaactggactgtttctgattaagtgcttgcccaaaggaaacttcagattataggttttcaataaacactggcaaaccttgatttgtgtcttatgtaactgaaagttttacaatatatttttgttccctttcaatagtgtatgtttttcttgcttctcttatgtaatattgtcatctgttcattcacataaataagtacttttacccatgacaagaatcttcctttacttcctttacttcatgcccagatacagagcactgccatcaaaaagaaaaaaaaaaaaacaactttaaactctcaatcattctataccctgtggaggatttctgtcttctattcaaactctgttttaccataatattacgttgtcttacatatgaatacagctatttagaagattttaccacctatgcttgctggccatatccagtggaattgcatcatacatactttggtctggtccacatataaggcaaaaattaaatatggcaaaattacccttgagaagtttcttaaattgacaatataatagagtagacatgactttgcatatagaatcctactgtcgacctaaagggaagagcctgaagcacaaaatgtaacttgaagagtttatttgaaccaaaataaggatagctgcctggaagactcagaccatagtaatcttggatatgagctctactggccatagttaaaagcaggtttttaaagggggaaaaatggggatgggggaaagtttttgttaggaactctcattggtttacagaaataacattcattagtgattggctatccattgttaagctatagggcatgggatatggtgtccactgaggcattattaggttaatgcatagctatttgtggcaattgcaagccatctccttagatgaatgtgtgtctcaaaacagaggaagcagggtgtgattgctatctcattttacacctccctgggcctaataatttgaaaaggctcacattcctcacataaaagttcttttctttcctcactacataataattttattcaaagtaaagattgaggaacactgaattctaaagaaggggaagactgaagtaagaaaagcatagaaggaaagcctaagggcagagagatgtctggatggttaaaccattctgcttttaagtcagcaatctcatccctctagtgaatactggatagagagagaattttaatgtgctcctgctttgcttcagggtctactccatcccgttttaatgttaatcctctgtgacattatcatatgtcatttggcttctttgtgttgtgagacttaaagatcatggtggagagcatctttggaacatgggggatggaggggagtgagtaaagaacgagggttctcgtcccgtgtaaaaacagccaaccagaaagcatcgtaagacaaacacctggctgacattttgaggattctgaatgggaaatgcccaggtggatttgggaagagctaacacagggaggagctacagaaatgactggtgcttgtgtagaaatcatttttcaattaaggcattaagggaaatatagagtttcttgatttgcattgagtgaatctagtcactggttttataaaattttgttatcagaaaatgtgtgctgtaaatatttagtacatacactaaattcattgccagcttcctattgtggtcatccttgatattcccctgaaaattagggctgctttatcagaggctcaacttttgatagttccccccacatcatattaaacatattaaaaggtaaccacaactcatatcaactatactcttgatggtaaggatatatttttatctaatattactcttgacttttattttgcaacttttcttttgtactttcagtcaattcattttttctatgccaggcctttgaaattcttcaaggccctaggctaggcgataaaccctaatgcttggtggataaatttgcctttctgagaagaatgcctcagtcattctgaagagtattgaggcatttgtccccttcattgaatagaaatagtgcaagatctgtgctctacaaaagctaagagcacgaaagttcctgaagacccaaaaattaagtgtagggggcaaagaaaaactccttcatcttctgaaattttgatgaaaaatcaatgggcaaaaggcaggttaataaaagaaaaggcatacaaatttattaatgtgtacatgagggagaatcacagtgattacactaaccccctaatggcatataaaaacttacatactatcttgaaacttcataaagaatggggactcagtgcatggcccaaaacaggttatgatggtaaatcaggttatatggcaagacaggttagggaagggagagaaaaggaggcctggctagcaacgttggtctcacaggtagcagccctcagagaaaatagctggtaaatatttcttttaggcctttaaaagtgtcagactctcagttaatttttcctagactggacaatgggggcttcagagaaagcctggttgtatcagtgcagattttctttatagatacaaatctcccccatgaaagaaaactttgctggactacttctgtttgctgactctctgaacagccgtctcacactatgtcaaagaagcatattttggagtaaaatatttttatttccttcataagtcttcctcttccatatgcatttggcataaaaacaaaaagattgttttaattgcctgtgggttcttcctgtccactgtacagacaaaaactaattcactgagaccatgatattgcagtaaagaaagagtttaattaactcaaggctggtcacgtgggaaacctggagttatcactcaaattaggctccctgaagtcttcgaggttaggatttttcaagggtagtttggtgggcagggggctagggaatggggaatgttgattggggttgaaatgatagaggtgtggcaaacagttctcatgtgctaagtcagcctccaggtgggggccacaggactggttgggtcctgagtgtgtgggtctcagtggagtcagttgctagaatgcaaaagtctgaaaaaatctcagtcaattttcagttctacaatagtgatattatctacaggaataattggaaaagttacaaatctcgcagcctccagaacagtagctgattatcatttaactacttctatatcttaagagaattcagccccctctcatagtcctaactttgtggcctttcattagttttacaaaggcagtttacttttgggaagggttattattatccttgctttaagtttaaactaaattcctcccaaagttagcttagcctatgcccaggaatgaccaaagatagcttggatgttagaagcaagatggagtcagctatgttaggtttctcttactgtcataattttgaaaaggcagtctcaatccccaacaaaaatgctgcttgatgaaaccagtccacataattatatttgcattataaggcatataaattaaaatcttatttttttaatagagctttcttagctagtcatggaggattaaagagaacttagtgtgcttccaagaacgtgaaaatctgcagagggacacaacgtcagtgttcaggttgtttggatgaattgcaaacacagttgtttcctgtttctgcacagcctccatagtgattgggaaatggtggtgtgagatggagccttgcctagaaggagaagaatgtaagacactccctgacaattctggatggatgtgcgcaacaggcaacaaaattaagaccacgagagtaagtgcacttatttcaaatgtattttggatgttacagactgtactatttgagtttgtgctgtgcaaacagcatccacagaagctttgcacaggagagaagattctccactgacagaaagcattctgaactatgcagatcagtgtccatccgtgaatgagacgttagagattgaacttgactttcccacactgagcagtttagtgtttctgtcacagactcataaattaagttgggtttccagccagagtggagaggaatcatgaggtaattattcggataattcatccaacatttataatgctcagaatgataatcaaatgaacttcctccctaattcatccagatggtttgctgaaagggtctgcgtttaagtacacctacagaagccattttctaatgttctttaaaagagttctgtgatgatccgtcagagaactgaaaagggttttggggagtgaatacatcattctttgatttctttggttaaatcaggagtgatcttctaaataaataacaatcttcagggtggggtaatccaaaccatcaaaattggcacccttatgctggagcagggcagaaaggcccagctagctagatattaaccctgtagttactggacagccttggaatcctaaaggggacaggggtgggagatgctccggatgcttaagatagtaattatatatccactaataaaaaagtatgtctatttgacaagtgtggtcatatgtatgtgtatcaattgagtatcagccctgtttctctctctctttgtctctctctgtgtgtgtgtgtgggggggcatggggtgggtgggtgggtgtgtgcatgtgtgtggtggggggagggggtgcatgcctgtgtgtgttttaatttacaggaatttttcttgagagaggggggtctcactctgttgcccaggctggagtgaagtggtgtgattatagcccactgcagcatctaactcctagcctcaagctatcttcctgcttcagtctcccaaaatgctgggattacaggcctgatccaccatacccagcctgtggagtattttttaaagcaagctccatcggttacaaatcccagtatgctgaagttttattctaccaaaggtctgatgtatttgaaaggatgtctctgtttcccaccccttattattaatcttgacttactctttcttctcagcctcactttttcagtgaataaaattggttctttcgtctttgtgatgcagaagacaaaactaatgctacataatactatataaaacttatttttcacatataaaataggtgaaaacatcttgtgtatcaaatttccttgccttttttgacccccttgaccagtagtaaatggctatacatttccggcttgcgaccaggaggaacctctgaaccaccctagcttgctaacatgcatctgtctgtgcctgagtagcttaatgtggattatcctgtttcattttaatgaaacacctacaaaagacattattcagaaataagcctggttcatgcaacttatccacagagaccattttaattaactagtagaaggtgggaaatcaggtttccctttggttaccttttgcctaaaactgattcttcccaataatttgaagttgccctcacaaattggtttgttttaagctattctgaattatggccagtatgattggaatctaaccacctttgttttaaacacattgctgatatatttcctgccaaatctcttttctctattctaaagaactgattgccttttattgaaggcaagtcttattctcatggtgtctccagacctgaaacacagtaaagaaaaataattcaagtcaggatttaaatatgtgaaattccaagagtaccaactaggagactctttggaagatagaatataaaacaaacaaaacaaaaaaacagaaacatagattgttaatgctacttttttgagaccaatgtaactttcttttatttggcctctgtagagtacattttaaaaccatcaggcatgttgcagatgcaccctagacattttccaacaacacaggagtattgtgcaggatctgatcacagtaccagagactggagcacaccatttgctacctccctgggtgggctgaattcaactcaagcagttgaatggatgagataaacaaactgccattgcagtcggtttgaaagcagaggatgtacctgttctgacgtatacatccttttcaagcaaggaaataggaggccactctacagccatgtgagctgcacatcagtcagctgagaattctcaagtctgtccttagaaaaggaaagagaagacactggaaaagctgtactttttaaaccttcagaggactcaaatgctcttactgacatacgtcctccctcctccctccttctcaagaaatttgcaatgaaataagcacttttaaacacaaggagcaccaactaagtccagatgatgtatataggaaccatctattctgtgtaaatggtgtgtcaacgccagtccttagatcatctgctctgaaaatatgttctgtattaatttttcttctacatcttatgtattcttctccatcagagcacaaatatgcttactcacttcaaatattgattctaacaatttaactttaagaatggtttaattcacagatgtactttaattattatgagtcacatgttttcattgttctgctgttatcaaagaggtaaaaaaaaaaacaaagaaatttacctcttttgttcttttttgtgtgagaataattcaaagacagttcactcaggataaaaataaagttggggaaacacactcagattgttaatagcaactgagagtttccttcatactgttattttaaaagtaacttcaatataaagataatccagggaaaggttcctgggacttcattctctttcctataaaagactgttccaaaccttcatcttttgtaggttacttccaaaataatcatcctgaacaaaattctcttcgaaatgtggttaaataatgtttcaaagtctgatctaatttaaaactttatggtgttcattttttaaggaaggtgaagagtagaaatgtggtggttcatctaaactaccagacaccccagaacgtctggagtagcccaggtaacaggccacagtctaaagaaaaacctcaggaacaatggatctgagtgatattattaccccagaaggaaggagaaaatataggtggaattaggcaaagccttttctttcaggagatttggaataactttttaagagaggaagactcctggatgccaccctatagaaaggaagtattcaccttgaaaggttttccaagacccagcttggagtagaataaatctggcaacacacacacttctggggagaatctcagtacatctgggtgaagtttcatggccaaattattcctctgcgtctgcttgatcattgcttcaattgctttattaaatagctttgttggtacttaggagcaagactaaccaaccaaaatattgactagagattttattcttgcagttttagacacctatttatttacgtcttttctttaaactatatcaaatacgtaagtttgaaagttggggaggctctatcccatgtattcagatacatgtctataccttttatattcaggaacaatggcttaatttagaaagacagacttcccctcagagatgtaaaactgaaaagtatctgagacaggtcttactcaatttagaaagtttatttggcaaaggttatgaatgcatgacctagaggtaggtctgtgcctttctccagagatgattttgagggttttaatatttaaagggaaaagggtggatattggggaaagaagcaaatttttaaaggtgtgggtagttaagagacaaatggtggttacattcttttggtctttgacagcctttcaccaaatacaccatttacatgtgggaagggggtagaggaagagccacttaggccttcatgtagctcagttaatctttatttttacgacagaggacgcaatcagatatacatttgtctcaggtgagcagggggatgacttagagttctgtcctttgtcctgcacctgaaaaaataagttatcagtttacattgccagggtaaaattcaacagaaaggttttaggataaagatctgggacccacaaggaatttccctgtggtaaaattgtgagggacgtatgtggcttttgaaacatctttgtagctatattatttaggaataaaatgagaggcaggtttgcctgacatcattctcagcttgaatttccctttggcttagtgattttggagtccctaggtttacttgcctttcaaagacaaaataagttatttgacaatgatggaataatttcagctaaaaactgaatgtcagttacttggtggcaggaagaggaagaggaggaaatgaggagaaaatcagtcactggaaaagacaaactaacaggttaaaatagcagaacataatctggtgtcatatcttgggaagcagcaaaccacgctgggtttgcttcattccaatatgtgaatgtctctcagactagtgagaaaatcaacagttagtacacaatgtaaagtcaagttttattccctaaaacgaggaggtagaagaccccagattgcacaattaaccactatagccatcttgtcaaatcagtgttttctgtaactggcccaacacaaatccacctgcctaactctaaaatccttaaatggacttctacctctagcctcagaacactcaacttctaaaactgtaaagaagtaagagataataaagaaaaatgccatatttcctggaactctagagtagagtcttcaactctattagaattgttatttatgcttgaagttagtagttctctgtacatgcgtccttttgaatatttgagcctttgataccctattcaagtggattaagacatctacagcaacagaaatgtaatcttgattgcccttgaacacagtgtcattgagtgcaacagtttctcaccttgcacaggaacagtttctcatcgctgtgttcctacacagatgtggtctaaccttgacaacgacctcacctcatgccagccctctatatcttacaacaggccaacttcacaagaccatggaataacttacccagttcaaattctcatcagatagacacaggagtgattacataacatgcaaggccaggtgcaaaatgaaagtgcagggcccttgtttaaaaattattaataatctcaagatggcaacagaagaacattaaaccaagcaggaggctctttccaggatagggccttgtgcaacttcataggtcacatgcctaggaaaccagtcctggataggcattgctccaggagcctcactcctcaggagtgacatcattaatttattgcattgataaaaatatggtggcctatcaatatgatttgatcaccatttgaaaatgactgctctaaactttaagatttttgacttcagatcacctgaaaaaaagcaacatcctaaagattcaaggtgtcctccttttctacataatcacatttctttgtgccttcagtttgcactgttctccctgaaatgtctgtctttctttggtttcagattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaacctacttgtcttctttattttgccatttatttttactgaatcaaccttaaccaaatccagagaatgcactgctcagatactcatagtcagccagagcttctcccataaggtctttgcttccattgtggctactatttacaatgttaatattttgaaaatcagaactccattactataactgcagtgtcctcagtcagcaagccgaaatgtcagatgccattattgggctttcgtagttgttactggaataatagatatggggctaaccccaccaaaaaatgatcttctttttttgagagttactcagctaatgcttataagaaggaaatatctacttaagttctagttttcctggagatagcataatcatactttccgttccagtcatcttgtaagtgtatccctttttctgcaaaatatattctctggaatgaatattgttatggcttcttattaggttagtagcacattgggccccatagtctcaacttttaaatttaaatctcaggtcaaatccagaggctcccccatctctaccaagatagcctgaagtctgattgaacatacaaacactctaaccagataaactgattctgcatcttgaaggcctataaaagcatccagagacagaaatagaatcctgactgcaaaatctaggcttctcaaatgctttcacaaaatatttgccagaaggtagcacaaagtttacaccagaaaatcggaatattttgaatttatgatccagatgcaaaatatgaagaaaagaacttctataatcaagtatatttgggaaagttttttaaacaaaatagagatatttactgggggaattgtcagaggctttaataaaccaaaaggcaccgtgtgtctttaggaaagactagaagaggagaagtcaagtaagaaacctctagttggtcacatggctaatggagcacacatgccctgcataatgggaaactgtaagaaattgcttctatgtgaggatataatcactgcagtgttatatcttcagtttttcaaaagaaccagaaatctagattttacataaaattttctatcatgcctaaattgagatgaactaattcaatgttttaaatgatgccagcgttagtattgccccaaattctctgaacatgtggactttactattagtgttccctaggatactcttttaaaagcattgatcctaaatgaaaatccaatgggaagaaagagggctattctcttttgtatggcctcatacatgcagacacttctcataactcacaagatgtcgtggtcacagcttttccttttctgtaaccagagcctttaagtcaatgaaggggctggtctagaggtccacatctgttcattcatttcccatcggtcaattcatgctagtctttcatgaaaagacctggagaaaaaagtcacaacagaatcaggaaatcatccaataagacagtgcaaatatttgtaaatgtcgtcaaattcaatttggatttatccaagtcccttacacaaatgtgtgaaccatcaaattgtgtttaaatttaacttgctccagtttggggaattcagtagctaccatctgcctattgaatctgcacatttatggtgtaaaaacttatatcacgtatttctggtaataaagagctctgtgtggtatgactaatattgattttgagcttgtgcatccaggacgatgaataatgttataacataattagagtaaatgcaaagagttttatccagagcccttcttttagtaaaaaagtgaaaatgtggcttatttcataagattaagattttcaaatagtgtgaatcttatttgttgacattttggggtgattagattaatctattaatggacgaggcaagcacattgagaagtttactacttggcttttttacattgtagaatgatgaagaatgttttcaccgagacacaattcaacatgtttttttgatcaaattgagtataactttcacaaagcaatacagtggttttataatacagtatattataccaccttgccattgtcactgatacagtaagttatggaaggcataaaaattgtttatctgaggagatccaccacattcttcacctgcacaaggcacacactgcttccctgggaggttaaatatcatgtcatagtatgactttttcttttaattaagcttgacagccccatttcaaaagctattagagttttcttgacaaagaagtgtgtcatgtctttttgtgagctgtctaccttctaaataaaagactgcgtgtttagtgaattgtagggctcgagccatctccagctagtttataaatacaagaaaacatgataaaaggcactactctggaatgtgagaactcagtactagtgggagcagtaatggaatcttatttcatactacccatgggaataatacaaaagtgatgaaatagaatcaggttcacactttaaattaaagatgaggccattaattgtacatacactcctcttactatatcccctattaaaggtttagagatttgaggttgaataggtcaggattgttttttccttgtgaaagagctcagggcacatcaatggatgtcatgacatgctcacatcattggtacacaagtggctctcatttgtttatttacttaggtagtttgcttcattttcaaaaagtttaagctctcattctggtagctagttacatcattaaaagaaataataattggttaccaaatatgaaagccaggatcccagccctaactgactttgatagaccaggcaatgtttatccagccctgattcccacctgcttagagaagctataacccaagaatagactgacatgctatgaagaaaacttgcagccaaattttccataagacggtgtattgcagccatgaggccatggcacatggatattggccatagatcatggaatgggttggaaatggcttcttcagaaagactgtgaataatttttttttttttttttttgagacagagtcttgttctgtcaccaggatgaagtgcagtggcacaatctcagctcactgcaccctctgcctcctgggttcaagcgattctcctgcctcaacctcctgagtaactgggactacaggtgtgcaacaccacacccagctaattgttgtacttttagtagagacaagatttcaccatgttggccaggattgtctcgatctcttgaccttgtgatctgcctgccttggcctcccaaagtgctgggattacaggcatgagccaccaggcccagctgactgtgaataaatttttaaaggcattataattggttcaagggtagttctcaaacatggcctaaaaggcacataagcctacagaagctagccaggtaacaaaagttagttaagcagggccacctacagtgcctaaaataccaagatgaaggtagaaaccctggcacattgcagggcactagtagccagaatttgatctcagcctattgttgccacgcatggcaccatgcttaatgctgctcattaaggagccatatgtccacattcttctgacttatttttaggactatccagaaattcagatgctggtatatgaatgtggacaaaaacacactcaaaatatttttcctctgctcccacaccatacaacaatcaacacagaagacttctgtgaccagatgtgtgggagtttttccccgcacacgaagcaagcaattctgcagtgaataccagctggatgtcctctaattcaattccattatgacacatctacctggagataatgtcgcatcccacaggttgaaggctcagtcccacaggactggcctccatttctgatgccagtcacagccccaagttgttttacctgtgcttctgactgactggctacaaactgaggatcccacaaccccctccttgggttctattaatttgctaaagtgactgatagaatgcagggaaacacttacttttatttaccaattaattataaaggacagtacagaagatatagatgaaaagatgcatagtatgaagtataggaaggggtattgagcttccatgccctccctgagcacactaccctccaggacctccacgtgttcgtctgtccaggatctctccaaaccctgtccttctgggtttttatggaggcttctttacataggcgtgattgacaaaatcattggccattggtaatcaggtcaaccttcagctcctgtcccctccctagatgttttgggtggggctgaagtcccaaccctctaatcctgccttggatctaatcttttaggatagatggtccttccagagaccagcccctatcctaaagctaatagaagcagccagccatcatcagtcagctcgttagcatataaaaagacatcacttggaaattctaaggagtttaagagttgtatgccagggaaccatgttgaaaatcaaaaatatatttcacaatgtcacaatatgaaatgtccaaatctcatatatttataacccattggaattttgttaaatctggcccaaaattatattattctcatatatttgcattttcatgggattcctctggtggtagaaaaagtggcagaaaaggctagtttgcaggcaattacacacaacctatagcctgtcttacctatgccactgaggatgctgtgggcacatcagttgtcgtctactgcatgaaatgtcagggttgcaaaaaggagccaacctctctcctagaatggagtaaaattattacatttccatgagctccaactttggggtaaccaagctagtggaggagcaaacattggggaccaaaaggaagcagtataaggttgccagagcctatcagttagtgcaaaaagtcccgagatgcttgtacatctactcaatgctaggtactggctgcccaataaaaatggcctccccctctgattctatattgagtcacataaaatcatttcatgactcctgctgctgtctacattcatacctggactccatgtgagttcttgctgtgtttggatcctaatctgactcctcccgagatggctatactgagaagctttcaaggtttctcaccccctcccccaccgctcatctcaccactatcacattttctcctctcttctcccctttacatctcacacctaaaaggcactgtgtgtattgaaaagaactcctcagagattcaggtccttgccttccatttaaaaattcaacccagaaaagcttgcaacctctctcccagagtttttgcatgtaaaatggaaatcattatacaagacttaaaggttatgggaggattagagaaatggagaaagtgggaatgttatacaaatataaagcagtagataagcaatggttattcccagagaactgttactgtgttattctcaaattactaaggtgtcacctaggtgctccctgtgtctctgctcgctccactcaagacagacaaacttagcaaaaataaccaaaattttatttcatattccttttctagaaacctggaagactagacagatgctttctcaactttgtagaattctccatctgctagacagtgtttttaagccactgtaaaatgctggtataacccacacttgagtgacaccattgacataagcaagtaatagcgtgttggagaatgcaccctgctggtgtccagagtgttaattcagaagttgagttgctaatgacttgtgccatctggtgtgtaagaccatgatcagcaactacacacaatgccatggccaggccactctttccctcacactcagcccctttgtcattcaggctaactgtccaagcagattcacacataaccctgcatactgcagaggtgtgacctttcatgccctctcttacacccacttcactggtaaagactttttttgttcattaattcactcattcattcaataaacaaatatctgttgagttcttactatgtgttaggaacactactagatactgggggtgacttcagagcttacattgttctagaggaaacagacaaaaacaaaagtaaacaaataattaaaaatcatgatacaaaagaaattcagaacaagccaaggaagtaaacaatgggagggaaatgctaactttaggtaagatgaccatggaacatctcctggaggaggtggcatttagctgagaactagaggatagcaagatacaacgatgcagagagctgagggggagtgggagtgaaccagtgggggtgtttcaagtggacaaattagtatgtgccactgccctagccaaggaagaactcaatgtgtttgtgaaacttacagaaagtctcttcagtttgatttgaaagcagagtaattgagagcaaagtggcatgagactggggaagtaaccttgaagtcagattatggggccatgtagggcatgataaagagtgtgggttttatctgatttgtagcaggaagccatgaaaaaggatttttaagccaagagtgacacaatctgatttatacttgcagcagatgctattggtgtctatccatattctgtccttgttcccttatacgtgcagggcaaaccagatatgtcagggaattaggagagcaaccattgacaaataaggctgatatataaatttccagctcccttgctcccaggtgggcaacactgaggtatgctccacatcagggctacccagtggaactttctgcaatgtgaagatattctgtatctgagctatccaatgtggtagccaattggcacgtggaactattgagcacttgaaatgtggcagttgcaatgcagaaactgatttttagttttatttaattttaaatgtttaattaacctaaaattatatttagaaagccacattcatccagtggctatcatattgtactgcacagttctcttcagcatttaagaattcccaaataagactgagcccaagttacccaaagctgcagcctgcccataaacacacactttattggcttcccttaatttcctgtcttatatccttacttccttatcagtgcttcctggcttcatctttcaaataaaatcctaaggcagcttttaagatgacaactctggtttcaaaatggagaacagattgaagggcacccaagtaaactgagaggaccagtaaggatgtttttgtggtatttagtaatgtacgtggaagacttaccatgtcaaagcctaaggacagagcagtcaataatactattcctttcatggaggagatgatgacttagattcaagcctcagctatatcaatcagttgccattcagtggaccgaactatctaagcccatcttgataaacaagaataagactatgctgagtcttttagaggttattcatagagagaaagctttcgtttcatctgattcagtctactcccatgagacctagcctcactgtcagtgaacaaagttcaaattgaattatgaatgagaaggtttcaaatttttctcttaatcccagtatcttcttttactgaatgttaaataaaacatagcatcccagtaaatgcattgggttaaaagagtcctaatttttagtcctaactgagggagtcacttaaatttctcaaatcaattcttagaactggcatcctatgcaggcaagagcaaatgagaacaatgaggaaatatggtaagctagctaaagaaacagtttggaattttaaaagacattggcaaaagatttagcaaaagcaaaccatcaagaaggactatatataagaatgacagaaacctggaagaacatactaaggaaagttaaattcccccagtaacttatggcttcccaaaaatgctaagagcaacctaaagagctttttgtagttaagttccaagcaagaaaaacaaggaagggacaaacctactgcctgaatccaataatgtgtaggtgatagagaattcagatttttctcaagcaactatgttgtttctgctaaaatgcctagaagaaatagtgtcaagagaaaaataaacccaagataggggaagagatttataagacagcatcttgctctcctcaatgattgaattacccaggatgcatgacacagggaaagggaaagccttgatttgtaccatctattgattcctgtggtgtaaatcctctcactacagctggtttcaagataccagtgtggagttgggaagagatgtacacagccggctctcacaagccagtaagagccaggtcctgtatatcactccctgcataagaactacattcctaaaaccagaaagaaaaaaaaaaaactatcgaaatagtgccacaccaatgctaaggaattttgaggcaccaaggagaggtgccagaagttagaataagttaagtatagttataattattttaaaacataagtagattctgaaaactgtggactagtgaccctgaggtatattctagaatgtatctttaagtgaatttttatgaataattagggaaacagtaatcactagaggccagcttgagttcactgagaaaaaaatcatgtcagacaccttttccattggcctcattgtttagtctgaaggattaagtttttaaatgatggacataatacatctagaatttaggaaagttcaagtccagaccagagattggcaaactggctcttacactaaatctggcctgctgactttttaaaaataaagttttattctaacacaaccatttgttacatactggctatagctgcttttgcacaacgatattagtagaatggctgcaacggagactttaaggcactgaaagcataaaatatttactatctgatccattataaaaaaaagtctgctgacccctggcctattatggagaagtctggacattcgtaaaacgttgtgtaggttcataatcttaatgaatagccatatttaaatgtttttaattcatggactaatcacatgctggagaaagatttctcgtagcagaatcctgggttctgtcctgactatgtcttatgcaatgttttactatcaactatgtgaaagagggcattggcatggcatgcagaccaattttgcaggtgatctacgttcaaaatggccattgactaccttgcatggttgaagcaagttcaagtaaactagacaagcaaacaaaagcagctgtgatgattagacacagtctaagaacgcagtgttcagattcatggaaaaacaataagtggatcaagaaagtgagctgcatttaagtaattaaaggtctgtcatttagaaaaggaatttaattaatttttaaagagtgcatggaatttatagccaaacacatttcagtttaatataagaatgaaccacccagcagactttctttggtaggtagtgagtttcttgttattgatggtgttcaaacatagactggcagaaccgttaggaatgttgtagaaggattcatgcctatacagtcttttctttcccagaatttgtggttctctgagcctgcttcattatctgtataatgaaaatgaaattagagatactctctaatgccagattcttttgacacaatgaattctagattcagaagagcagctcataccatctataaggaggttgctttgttcagaaatacagatatcccttaactgtctaacagcattgcttactggcaaaaacagggtgtttttttttctttttttcttttctttttcttttttcttttttttttttaaccaatttcaatggcatctgtttcttcagagtaagtaagccactcgaggcaagccagctccatctctaattagtcagttacatcagtaataggatgataatggaaaggacttggagtcataggaattttataataaaccaatggcctcttttatggagactggcagaaagacttcagagatgttcaatcagatataactataactgcaaagatgaacctgccaagagtttgataacagggaagcagaccaaatacaaataggtgagatgtaaattggccaaaactataaaatggttgaaggcatgaattggttcaaaaatgtaaaattgaataagtaacttaatattttagccagagatctcaccactacctttacagataatgctttatcagatttgtagatatcatctaattatatactagctttataaagcaataacatatgagttaagggatatgcaattaatgaaaattcatctagacaaaaatctctcaactctattttgcattccagctttaacatgctatttaagatctcaacaatcttttcagcaatgtctaaaaagaagacaccagatttttttttgtctcattacaaattttgtgtttcttacttcagggaaaatttttaaataggaatagtcacctccaactcaaaggtgcaatggccattgttaattaatttgtcattgtggcaaatttgcagagttcaacagaaatatacaaatcacttgtctcaaataccctgaggagctaaacaatgcctatgtgcatacaaatactactgaagaaatgtgtagcctatgtcagagggacagttctcacaaagataatctcaccacagtcttgccctaatacagtgattgtcaactttacaagatctaatactgccttttgataacagaagtgaaattactctctcgaaatgaaattaataaatagtataacatccctatatatgtaattcagaaaaatcagtgtaactctcaaatgtgagataaaggagaaatataagaaaatctgttttaaaatgtttgttttaatttgtaaatagtctggcacataatgccagaagacataatgatatagagttgtgtacatatttataatgagtaagtattagatttaagggaagtaaatttacctagatacagttgccatattatgttttatattttaaaatacaagctaagtaaaaatacgtgtgcacatgggtgtaggtgtgtagatataaactcaagaatacaacattgtaaataaaaacaagttgttttattgatgattcaaatccacaagccaggctactgttgctgacatgatttttctaaaatgataactgattcttagtaaaattgagaacaaaagagtacaatttttcccccatttacatgatagttgcattcctgggtaattttaacataaatcaaaataatgccaatgcaagcatccatcaattgacaaacggataaaagacactaggacatattcatatgataaaatattactcaagcataaaaagggatgaaatattgatacatattacaacatggatgaatcttgaaaaccttatgctaagtgaaagaagctagactcaaaaggtcacatattatatgattccatttatatgaaatgtctggaataggtaaatctatagagacagaagtaatttaatttctgagggctagaaagaagggggacatgagggagtgactgctaattggagactaaaatgttctggaattagatactggtaatcgttgtacaatcttatgaatatactgaaaaccaccaaattatagaccacttaaaaagagtaaattttatggaatgttaattatgtctgaagttttaaaaattactttttataaactgagttcatttctgggcttatatcattatgagcaggtttttcacttacattaatattcaatgagacattaacaattcagtgggacaacaattcttctttgagcagaaatacatcgtacacttcaggacatatagcacttctcccagcctaccacatagtagcagcatcccacaactgctgtaacaaccaagaaatcattgcacaaatttccatgtggccctcaaaggtatttttagatttaggtattgtgcctgttgagaaccatggccctggcagcatgcatgcaaatataaccaaaatgtataaatagtttgtagtacaattccctggatttctaaactgacaaatagccacgacttttcaccccttagagaccacttcaaggactgtcctagttgtgtgacttggtcccctcacctgtctatctgtcatatttcatcccaacttttaagatagcagtgtggcatgttttcttgtgcagtaatctatgcaatatttgcaggattctgagttatttttctaaataaatatgactaggatgtgcagtatttttgagaatttgcaatatcccttaaggttcaaaaatatgtttctcaaagaggaaaagttcagcaatgtgcttcaaggcagaggataaaaacacaaaaaagattccaagctagatgttttcctgtttctcaaatatttaattttttatttttcatttaaaacagtaggtaagggccaggcatggtggctcacgcctataattccagcactttgggaggccaaggcaggtggatcacctgaggtcaggagttaaagaccagcctggtcaacatggtgaaaccctgtctctactaaaaatacaaaaattatccaggcttggtggcaagcacctgtaatcccagctactctggaggctgaggcaggagaatcgcttgaacctgggaggtggaggttgcagtgagccagatggctccattgcactccagcctgggcagcaagattgaaactttgtctcaaacaaacaaatagcagctaagagggcctcaaggcatgggaagggcttcaaatgcaaaacctagtagcagagtgcttgcagaattatagaagcactgtggactactggtgtcaccaaaaacagcaaacaatctttccagtttttattttcagtaattggccccttccaagtactgaagacttaaaacaaggatctaagtccgtgattctgaaaccaagttttggcatacacagggatgtctccaatggtttcaaggaaaatctaaaattcttaaaatacttcatttttttttccaaaataaaatatctccccagagtatcctagaagacatgggtaatgtagcgcagactttcacaaagttgatatcccagcctgctggccactggctgatatcactgcaagaatgccttctgtaacctcctgtgaatcacttttacttgtgggatgggattttaatgaaacaatcattaagtttaaacattgaccgtagtcccaaagagagaggaaaggaatgtattttattcaaaaatgtcattctttattctaaacatcgagtgaagattttaaaatcccatagtaggattagagacatgtcttgtgtttttctatgataattccatttgacctcttaacagaagcactgtgaattctacaactggaaataaaaactcctttttgttgaatattttaatctgaacatacaattaattccctctttgaataaaatgaagtctagccttcaacttgaccactcagcttttcacactggtttaagcttatatctaaaaagaataatagattcgggtcagattgagcacactattaaagaaactcaagatagactaaaagtctattttggggatagtctttcagtggggataaaattggtggtcattatgttggtttttataacttctgagattttttacagattttaatgacatttgaaatgtgtgtctgtgtgagagagagagagagagaaagagagagagagatgaattttactgaggcagctttaaagttttatgggtttcaaagttgactgatcccaacattatttaataatctgtagaaaagtgactcatttaggctttcactctgccctatctgctattagaactgccagctcccaggccaaaacccctgaacatgcaggaggatccctatgttcattaccatagtttcatactggaactcttttgcttcacgttttttaacttttaattatggaaaatatcacacataaaagtagacagaatgacaatgtcatgaaaagagacaaccagacattgtgtgcttctcgatggaaatacacatctccacctataaagaagtcttgcctaaaaaaaacaaagaacagatcaaatacaatgtaaatctgatcaagcctttagatctaactactaacttacagaaaattcaagagacagaagaacattttagacaacaccatggagatgttatcaacaaaatgcagactttgggaaaactttacagaacagagaaaatccaaattttcaaacttaaaagtagatagaattgtgtaataactcttctgtactcatcactcagtttcaacaagtgctagtacatggcccatcttgtttcatccatatacccacccagttcccaacctcagattattttaaagcaaattatatcttctgtaaatatatcacactgtatctgtaaaaaataagccattttcctcaaacttaaccataatacaattatcaaaacaaataaaaaattaacaatacattattaatactatcaactaccaagtcagtgatatttcccatggtctactgtcttacaatttttcagtaaattgcttgagtccaaataagttccatatattataattgattgatatgtctcttaatgtccattttaatttatatgtttcctttctgcctttctttttttcttctttgaaaaaatttttaagaagtgaattgtctctgctctctgaagttttcccaaagtctgcattttgttgataacatccccatggtgttgtttaaaatgttcctctgtctcttgaattttctataaattagtagttaaatctaaaggcttgatcagatttacattgtatttttttgttctttgttttttcgggcgagacttcataggtggagatgtgtatttccttgtagaggcacatagtgtctggttgtctcttttcatgacattatcagccattgatgacaacttctcagatacactaatattttagcagttacaaaggatgatattttaaattttatcattcttcctttgttcgttagccgaatacttctctaaagagaaattttctcacatcgttatccagaggtacagattttataagaaggcatgataaatgcttggttctcctggtttatcagctttcaaaatatggaattctttcaccagcaaccttgaaagaagctaacgaatattttagtatgataattactttatggaagtaaacatatttgatgcatttctctcctttgcacgtattattcttactgatgctcaaattgccccatcttcagccaattgaaacttactgaggtcttgccaaggacttataaaagaaaactacaaaaaaaattccggtagaaatttcaaggtcttcctgagcagcacattaaaaactcccttcctttgtagagtcctttacagagtacaaatgctctatcattttatttggtcatctccaaagtaaaaataacattggcagtcagctctcgggtgatagatggtggtgtccacattctgtagaagagtacacacagctcagataattgaagccactctgcctgtgtcaccagggcttcttgatagtaaagctgtgatgagatatcaggtccaatttcagggctcttaacattgtatcttaataaagctaagccacattttcctcatgcttattattttttattattcctttatacttgagaacagtcttaggcacttgttaggtacttgacaaaacaaatgtggaatgacaagaacattgataccccttcctgtagaacattttcatgctacaggctaccatggtgaattatatattatgttatattttctcttgtttggaacccagtacataaagctcaacaaaaagtccattctccaggatggagaaagattaagaaagtgttgcaagtcagcattttacagagagaaaattttattttaacaaactctagtcagttgtttgagcaaatgtaccaagaaggtgaaagaaaagagtttttaaatgattcttttttcagacaatcttttcctgaaaaagattaggaactttgatatgtgtcttaccactgttggacatttggctctaacccaataaactagatcttttccccgctggctggagacataaaatgagcataatatcttaagcatatttcaagtagattagctgcaattgtagtgttcaaaatggtcaaatgctctgaaaccattagcttctttcctccatcaccattcctattacattgtagggttcaatgcaattgggagtaagtgggaatttgctgaagagtaaagcagtgattttgttctccaagcaaggtaacaaaatttacataataagatgaaataaaacatttcacctaatgactgtttaaagaaacaattgactaaaaaaataataagcatgattcaaattaacatcaaggcaaaagtattttagcaaaagaataacagatgccaataacctctttctacatttgtttcctcttactaaagctggtcccttctaatagaaaggggcctctggtttgtgctacaagaaattaagttgataccacaacaatatgaaacatctgaatgaaaagctaaaattgaaatcagccaggttgtaacagatgtcttgatgcacaactgtcttacaccaaaagtctagatcgtaggttagaaagtattttctgcaaaggaacagatagtaattattttagactttgcaggaaactactgaactctgccatcaatatgtgaaagagccatacacaatacataaacaaacggacagggctgtattctgatacaacttaattacaaaattgtttacaaaaacaagcagcaagccagatttggtgtaggagccatagtttgcagacctccgatatggatgatagcagaagagtgtactttcatctgagaatttggcacttagttgcagggtgagagtaaaagtgcagactgtagaatatttttttaaagaactgggctacctaaggggccacagctcaaatttctaaaggctgaagaatttcagttccatgagaaatgtaggtgcatatgagacattcggaaggggtagaactgtagctaagcagaaagaacccagtgtcaaagaatcctgttactcagatgcacctgattgtcaccatgtggaaatgtacaggatcaccatctccactaatttttctatgaaatcttcctatttttagatgctggaaaataatgtaaaaattttaagacaatgtacagacaaactgaaacaaatctcaggacatccagaaaagtacctaggaggcacatagtaggttctcagtatgttggaagggaatatgggtgggaaggaacaagaaagggaggaaatgaggctgagaaggaaaaaagggaaaaagaaaaaagaaaaggagacagacagcaaaaaccattccctaaacaacagtttttaaactctgggcaagaggttacacgctagtcattcatatttggtaacagctctagcctgatgacatggtatgtgttagaagagaggagatgttttatatttgtttaaccaaaatgataagtgctgttttcaacctaatagaaatgaaataaattgaagtccaagatggtgaaagaagaaatctctatttttattcattgcccccactgtgggacacaggacaattgttcacctttagcctcagcacatctatactaatattcttttgcatgagatcagctggggagctttgtaaaaatgcctgagtcccaaaccccagagattctgacttaatgggtacattgtgagtcccagacttcaatatttctttttaaagtgtcatatgttattctaaagcacagccaagccagagaaccactattctaaactaagcgtacacagtgttaggatttggatttaggaagattagacaacacagaattgcttcagattgctattaagtgacatagccagtaaggatatgttttggaattgaatcatccagaaagttcaacagtcaaccacaatgacactccctaacccttccccaaaggataacctgacccatgtctcagatcagaggttggcgactgcctgcttttgtatggcctctgaggtaagaatattttttatatgtttaaattattgggaaacatttttttaaagaatacagttagtgacatgtcaaaattctataaaattgtaatttcagtgtctatacataaagttttactggaacactgccaagtgcactcatttatgtattatctatggttgccttcactctgcaatggcagagttaaataattacaacagggactgtgagtcccacaaagccccaaatatttactatctgtttggttttttttacagaaaaggtttgccaacccatgttttagaggaagactaacaaatataaaaaacatatttgatgtctcagtaggttaacccaacaaatgtttatttccccccgccatgtaacactgacacaggttccttccatctgactccaaaattcttaacctctttctgccttggatactgggcagtctggtgttgtctgtcaatacttttgcacagtagtagttttaaaatgcataaaataaaattcatgggatttaaagaaaattatattaaaactcagtgatcaaactatttaaaaacaaatttaatatgtagtaatatacatgcttcattattaaagtattaaataacaaaacctagcagcaagtttcataagtatcataatttttaaggagtcttgagggtaaaaatactttgaaatatccacaacaactataatgggatatgaaaaatctgtaatttctctaggtgacaaagtcacaggtacttgtaatagcatggtggtgatttgcctacattcataatagaaggaagtgctaaaatcaagttagagcctcctgaaaatacagatgtagaattttgtaaccaagcttagaaaatggttgaactccttgaattttatccatagactaaggggtccttggattccaagctaaaaatacctgagaggtttctacatttcagggcctatgaaaccttccacgaagcctctgcttcctatcagccagcaaagaagagagagcaagctcagaggaccactccagagatgttaaagaacaggcttggaagtggtataaaatacagctgcccacattccactaagcagaactctggcttatggccccacctaactgtagggaaagctggtttaaaaaaaaaaaaaagtccacttgtacacctcgaagggaaaagagatagcttgctgaatgcccattcagtgcccactataacctcctctccagggtactcctctccagaaagctatgggaagccatataagttggctcaagctgccaataagaacaccaaagcctaagtagcttaagcaacagacatttactttctcacagttccagaggctgggaagtccaagattaaggtactggccaattttttatctctcaagggctttcttcctggctggttgatgactgctttctcactctgtcctcatatggcagagaaagagagagaaagagcacacacagtcaccctgggggctaggtcttcaacacatgaatttgggggtaatacaactcaatccatggcagaagccatgttgagttcttctttaataattagagaagggaagatgttttgttcagagtcttcctagttgcttgatcccaatatggtaaacagttcacatttttccattttcatgttttatcctgaagcaacagagcattacattaattgacttgtcttattaattcagtaagctgcttccaggatgaaatgcttagctatgcttgtttgttttgggcccttttttggttattgggtgaaagcttcaaggcttaaaccactctgatgtttttcacaatcactgaaaaattttatgcactggtgaagattcaccacatttgaaatgacttcaaacttctagtttttcattattttataatttaattcacactttttagtatgataagaaaatattgagtggttcacatattgtagtaggatatttgctcatagttagagctgtgttttagcatttattgtgaatggcattcaatgcagttaaatgtggtagacttaaataaagtcaaaataaacaaccatgtaacaataacaactctagccaaaaacagtgaaatgtgggcttcacatacttttttcaaatttattttttaattgacataaaaattatgtatacgtattatgtacaacatgaggtattggagtatctatatacacattgtggaatggctaaatctagcttattaacaaatgaattacttcttatcattatttttgtggtgagaactcttaaaatccactttattaacacttttcaagaatacaatatattgtcattaactatagtcactgcattatacaatagatctccgaacttattcctcctatctagctgtaagtgtatagcccttgaccaacatttccctaccctacttcctcctaaccaacccagctgctggtagacaccactctgctctctacttctatgagatcaactatttcagattctgcttatgaatgaaatcatgcagtatttattcctccgtacttggcttaattcacttaatactatgtcctccaggttcatccatgttgtcacaaatgatagaattgccttctctttaaatggctgaatagtactccattatgtatgtatacaacatattttatttaaccatttgtctgttgttgggcacttaagttgattccaaatcttggctattgtgaatagtgctgcaataaacatgggagttcagctatctcttcaacatactgatttcatatcctttggatacatacccagtagtgggattgctggatcacacagtagttctatttttaattttttgaggaacctctatactgttttccataatggaagtacattctcaccaacagtgcacaggtttttccttttttccacatccttgtcaacactagttatcttctatcttttttgtaatagccatttttcaggagtgagggaatatctcactgttgttttgatttgtatttccctgatgatggctgatgtggagcattttttcatataactgttggccatttttatgtcttcttttgagaaatgtctattcattttttttctccttttcatatcaggttttttttcttgctattgagttgtttgagttccttttagattctggatattattaactccgtaccagatgtatagattctaagtattttcccccattctgtaagttgtctcttcactctgttgattatttcctttgttgtacagaaaccaacaaaggatttttaatttctttaggtttaattttttgtgtgtttttaatttttctaatggtgtttttttatgtaatcctatttgtctaattttgcttttgttgcctgtgatttttaggtcataaccagaaaataattgtccacatcacaagtgtcatggagattttatcctatgttttctttgagtagtttcatagattcaggacttaaattgaaatctttaacccattttgaattgatttttgtatatggtaagagataaaggtttaatttcatttttctacatgtagatatccagttttcccaacacaatttactgacatgactgtctcttcgccatgatgtgttcttggcacctttgtcaaaaatctgttggctgtgaatgtattagtttatttctgggctcactattatgttccacttgcctatgtgtctgtttttatgcaagtgccatgttgttttggttactataggtttgcagtatattttgaagtcaggtagtataatgtctccagctttgttctttttgctcaagattgcttttgctattcagggtctttttttgttgttgttccatataaattttaaaattgttttttctatttctgtgaagaatgtcattggtattttaataggtatagcattaaatctgtacatcgctttggatagtatagacattttaacaatgttaattcatgcaatctataagcatgtgatatctttccatttatttgtgtctttaatttctttcatcaatgttttataattttcagtatagagctctttctcctcctttgataatttattcctaagaattttattttttgtaactattataaatgttttcttgactttttttttttttttttttgacagtgtcttactttttaacccaggctggagggcagtagcgcaatcatagttcactgctgctttgcactttggggctcaagggatcctcctacatcagcctaccaagtagctgagactacgggtgcacaccaccatgcttggctaattttttttttattttttgtagatatagggcctcaccatcttgcccagtttggtctcgaactcctgagctcaagtgatcctcccacctcagcctttcaaagcactgggattacaggcataagtcaccatgccttaccttgacgtcttttttagagagttcactgttagtgtacagaaatgttgatttgtgtttgttgactttgtatcctgcaacttcactgaatttgtttatcagttctcacagctttttaatagaatctgttgggttttctatgtatagatcaagtcatctccaaatatggacaatttaacttcctcccttccaatttgggtgccttttatttctttcattttcttaattgctttagctaaaacttccagtattataatgaatacaagcggcaagagtggtcatccttgtcttgtttcagattttagaggaaaactttcaacttttccctgttctgtataatgttggccatgagtttgtcaaatatggcctttatttgtgttgagacacattctttctatatttttttgttgagagtttctataatgaagtattgttatattttgtgaaatcattttttacacctattgaaatgatcatatgttttttgttcttcattcttttaatgtgatgtatcatgtttatagatttgtgtatgttgaaccacccttgcatccttgaaaggaatctcacttcatcatggtgaatgattttttcaatgcactcttgaattctgttccctggtattttgtttaggatttttacatctatgtttgttagggatattagactatagttttgttgtagttgttgtgtcttagtctagtttcggtatcagggtaatgatggccttgcaaaatgagtttggtaatattcctacctcttcaattttttgaagagttttagaaaaattggtacttcttctttaaatgtttggtagaaatcagcagtgaagccatcaagtcttgggctttttttgttgggagactttttattactgatgcaatgtccttactcattattggtctgttcagattttctatttcttcataattcaacctttgtagattgtatgtgtcagaaatgtatctattgcttttagattatccaatttttggcatataattgttcataatagtcttttatcctttgtatttctgtgatatcaattataatctctcctttttatctatttatttgagtctttttttcttagtctagccaaagtgttgtcaattttgtgtattttttcaaaacaccaactctttgtttcattgatattttctattgtttttctggtctcttcagtttacttctgctctgttctttattatttctttccttctactaatttgggttttggtttgtttttgcttttcttgttccttgagggctggttatcaggttgtttatttgagatctttctacttttttgatgtaggcatttattgctgtaaacttacctcttagaactgcttttgctgtatcccattggttttggtatgttatgtttccattttcatttgtttcaagaaatgtttaaattttttaattgccccatttgttgttcagtagcatgttgtttaatttccatgtatgtgtgaattatttaaactccttcttttattgatttctagttctattccattgtgatcagaaaatatacttgatagtaatatgatttcaatattttaggtttattatgacgttttgtggcctaacatatgatctgtcctggagaatgttccatgtgcagttgaaaagaatgtgtattccgctgctgttagatagagagttccatacatgtctgttaagttcatttggtctaaactgtaatttaagtccattgttttcttgttgattttctgtctgggtgatctgtcattgatgaaagtgaggtgttgaaatgccctggtattactgtatgggagtctacctcttccttcatatctattaatatttgcttcctctatttcagtactctaacgttggatacttgtatatttgtaattgttatatcttcttgttaaattgacctctttatcattatataatgaccttctttgtctcttataggttttgacttaaggtctattttatatccaatttaagtgtaactattcctcctttctcttggtttccatttacatggaatatctttttctatccctttacttttagtctatgtgtgtccttccttatgtaggcagcatatacttgagtctcgttttgtaaaatttatccagccatgctttgtcttttaattggataatttaatccatgtacattcaaggtaattatttgtaggtaaggacttagtattgccattttgttcattgttttctagttgttttgcagatactttccacctttcttcctctctttgtagtttagtgattttctgtagtagtatgttttgatgccttgctttctattttttgtttatctattataggattttgctttgtgattatcatgagtcttacaaaaacgtcttttaacagattgttttgagctgaaaacgatttaattttaaatgcaaaaagcccctctgaggcaagattgccaactagacacagccagagggatcctctgccactgaaggactggaacatcaggaggactggtgcactcttagcagatttcagagggaaggcagtgagactggacagagggaagacatagatgctgggctgaagggggaaaatgctggaaaccatacatgaagctaccatccccccagattcattcctggccaccagtaactcctggggaaggggtgagttgaacaggcaagaagcaacccactcttaccaaaggcctctggaatacaggcaggaggagaccccatgacccccacagacacttgagttggcagggagacctgcttagagaaatggtaggagcagaactacagccagagtggagcccagagggtttggtgcaggagcatctgtagtgtagcacagccaggaacggccaccccactaggcttaacttgctcccataagagactttagccctagcgggaactgtcagacctgaactctacaggatggtcttgcctcggagatggggccactccaacccaagcaaccctcaatttactgaccccagcctggccactcttgcttgcagtacagtctcagctgtccaggaaatacctcctaggggcccacattgtagctcttgtactggtagatcacacctgacaacagagagctgcagcagagtggcccctacagacacacaccagcctgcccatgccctcccccaactgcagcctccctcatgctgctttacctgcatgcactcacccacagccattccccaaatttctttgatggtgagtgtgtgcagaggcagaccttgcctcccctttcccactagcatgcatggcacatgctccctgacacaccactgctgctggtgtgagtgcatactctcaccggccacacatcaccattgctattagagtgttggtgcccagagctcaccagccacacacacaccagcaccccacacctgccagcccccaaccccatagtgacactaccacctgcccaaaaatagttgtggagaaccgtagacccacccccaccctgagaagccactgccacctgcataaatgcacacagagggctcacacagccctgcatccaccagtaccccaccactgtgttaacaccaccatcagcatgaacacacagacaccactgggggcccctgtcactccatgctgtactgccaccaccactgctatgaatgcctgcatggaggccagcagcccagcacctgctagcgccctgccacagctgacaagtgtgcaccctgccatgctgccactgccactgccactgctgctgacacatacaaatgaggatggatcccacagccagcacactatgaaacactttggctggcaccacccattggagtattgtgactggcaggctgggagcacctcagcccttccagtgcaacaggttcctaacctcaaggaaccagagaacaaagctggggcccaataccagtcccccagagttacagcatgcattccaggaatcctaagctgagtcttggtcccctaaaatcttccagaaatgaagccagtcaactgaaaccaccttataccacaatcaaacctccaaggtcaccaaataggataaaagaaaaataacctatccaaaggacgacaacttcaaagattgaaggaacatcagcccacagcgatgagaaagaaacaggacaagaactctgccaactcaaaaagccagagtgccttctttcctccaaatgatgatatagttctccagcaagggttcttaaccaggctgcaatgtctaaaatgacagaaatagaattcagaatatggataggaaggaagattatcgaagttcaggagaacatcaaaactcaatccaaggaagctaagaaacacaataaagtactacaggagctgacagacaaaatagccagtatagaaaagaatgtaacaaacctgatagagctgcaaaacacactacaagaattttacaatgcagttgcaagtattgatagaaaaatcgaccaagttgaggaaagaatctcagagcttgaagacgacctgtatgaaataagacattagacaagaataaagtataaaagaaataaagtgaacaaaatctccaaaaaatatgagattatttaaaagaccaaatctatgactcagtggtatccctgaaagagatggggagaatggaagcaatgtggaaaatgtatttcgggatatcatccatgagaacttcaccaacctagctaagaggccaaaattcaaattcaagaaatgcagagaacccctacaagataattcacaagaagatcacctcaagatgcataatcttcagattctccaaggtcagaatgaaagaaaaaattttgaaagcagctagagaaaaaggacaggtcacctacaaagggaagcccaacagacttaacagtgggcctctcagcagaaaccctgcaagccagaagagtttgggggcctatattcaaccttcttaaagaaaagaaattccagccaaaaatttcatatccagccaaactaagcttcataagtgaaggagaaataagatcctttccttttttttttttttttttttttgagatggagtctcgctctgttgcccaggctggaatgcagtgacatgatctcggctcgctgcaagctctgcctcccgagttcacaccatttttcctgccacagcctcccaagtagctgggactacaggtgcccaccaccacgcctggctaattttttttgtattttttagtagagacgggttttcaccatgttagccaggatggtctcgatctcctgacctcatgatccacctgcctcggcctcccaaaatactgggattacaggcgtgagccaccgcacctggccaagatccttttcagacaaagaaatgctgagggaatttgttaccagcagacgtgccttaaaacagctcctgaaagaagcactacatatataaaggaaacagcattagcagccaccacaaaaaaacactgaactacacagaccaatgacactataaagtaaccacacaagcaagtctgcataataaccagctaacaacattacaacaggatcaattccacacatatcaatactaaccttgaatctaaatcaactaaatgccctcaattaaaaggcacagagtggcaagttgaataaagaagcacaacccattggtatgctattttcaagaggcccatcttacatgaagtgacatacatagcctcaaaataaagggatgaagaaaaatgtatcaagaaaatggaaaacagaaaaaaataggagttgtaatcctagcttttgatgaaacagaccttaaaccaacaaaggtcgaaaaagacaaagaagggcattacataatggtagatggttcaattcaacaagatctaactatcctaaatatatatgcatccaacacaagagccctcagattcatacataagtttttagcgaccttcaaagagacttagactctcacactataatagtaggaggcttcaacgccccacttacactattaaatacatcatcagtgcagaaaattaacaggacatttaggacctgaactcagcactggaccaaatgcatgtgatagacatctacagaacactccactagaaaaacaacagaatatatattcttctcatcgccacatggcacataatctaaaatcaaccacacaattggacattaaaaacatcttcagcagacacaaaataaatgaaatcataccaatcattctctcagaccacagtgcaataaaattagaaatcaagactaagaaaatgactcaaaaccatacatttatatgcaaattaaacaacctgttcctgaatggcttttgggcaaataatgaaattaaggcagaaatcaatttctttgaaactagtaagagcaaagatccaaaataccagaatctctggaacatagctaacacaatgttaaagtgggcatttacggtactaaatgtccacattggacggatcatgaggtcaggaattcaagaccagcctggccaacatgttgaaaccccatctctactaaaaatacaaaaattagctgggcatgatggtacattcctgtattcccagctactcaggaggctgaggcagtagaattgcttgaaccaggacctgggaggtggaggttgcagtgagccgagatcatgccactgcactccagcctgggctatagagcgagactctgtcaaaaaaaaaacaaaaaacaaaaaaaacagaaatatctcaaaatagcaacctaatattacaactaaaagaactagtgatgcaagagccatccaaccccaaagctagcagaagacaagaaataacaaaaatcagagctgaactgaaagagactgagacataagaaaaccattcaaaagatcaacaaattcaggagctggttttttgaaaaataaaataaaatagaacactagctagactaacacaggacaaaagagagaagattcaaataaacacaattataactggtaaagggaacgttacccctgaccccatagaaatataaataaccatcagaagctactaggaacacctctatgaacacaaactagaaaatctataagaaatggacacatacaccttcccaagactaatccaggaataaattgaatccatgaatagaccaataatgcatgcaaaattgaatcagtctaccaagcaaaaaaagctcagaattaattcacagctgaattctaccagatgtataaagaaggacttggtaccattcctaatgaaactaagcaaaaaaattgaggagggactcctccctaactcattttacaaggccaacatcatcctgatatccaaacctggcagagacacaacaaaaaaagaaaacttcaggccaatattcctgatgaacactgatgcaaaaatacgcaacaatatactgacaaactgactccagcagcacatcaaaaagataatccaatatgatcaagtaggcttcattcctgggatgctggttcaacacatgcaaattataaatgtgattcatcatataaacagaactaaagacaaaaaccccatgatcatcttaataggtgaagaaatggcttttgataaaattcaacatcccttcatgctaaaaactctcaataaactaggtattgatggaacatacctcaaaataatgagatccatctattataaacctacagccaacatcatactgaatggacaaaagctataatcattccccttgaaaactagcacaagacaaggatgtccactctcaccactcttatccaacatagtattggaagtcctggccagggcaatcaggaaaaagaaagaattaaaggcatccaatagtaagagagggggttgaactatttctgtttgcagacagcattattttatatctagaaaaacccatagcctcgatccaaaagctccttctgctaataagcaacttcaacagtttcaggatacaaaatcaacataaaaaagactagcattcctgtacgccaacaacagccaagctgagagccaaatcaggaattcaatcccattcatagttgccacaaaagaaaaaaatgcctaggaatatagctaaccagggaggtgaaagacctctacaatgagaattacaaaacactgctcaaagaaatcagagatgacacaaacaaatgaaaaaaaccttcaatgcttatggataggaagaatcagtatcattaaaatggttatactgcccaaagcaatgctattcctatcaaattactaatgacattcttcacagaactatgaaaaatatttaaaatttatatggaacctgaatagagcccaaatagccaaggcaaccctaagcaaaaggaaaaaaaataggggcatcatgttaccggacttcaaagtttactacagaactacagtaactgaaacagcatggtaaatagacaacagaaacagatacatagaccaatggaacaaaacagaacagagaacccagaaataaggacacacacttacaattatttgatcttcaacaaagctgacaaaaataagcaataaggaaaggagtccctatttaataaatggtgctgggataactggctacccatatgaagaagattgaaactggactctttcctttcaccatatacaaaaattaactcaagatggcttaaagacttaaatgtaaaacccaaaactataaaaaccctagaagaaaatctaggcaatactagtcaggatgtgggcatgagcaaagattttttgatgaaaacatcaaaaacaatagcaacaaaagcaaaaattgacaaatgggatccaattaaactaaacagttctgcacagcaaaagaaactatcattggagtgaacagacaacctacagaatgggaaaacattttgcagtctatttatctgacaaaggtctaatatccagaatctacaagaaacttaaacaaatttataagaataaaacaacccattaagaagtggccaaaggacatgaacagccacttatcaaaataagacatacatatggccaacaagcatatgaaaaaagaaaagctcaatgtcactgatcattagagaaatgcaaatcaaaaccacaatgaaatattatgtcacatcagtcagaatagctattgttaaaaagtcaaaaaatagcagatgctggcaaggttgcagagaaaaaggtatgcttatacactgttggtgggagtgtaaattagttcaaccattgtaaaaagcaatctggcagttcctcaaagtgctaaaacagaactacaatttgacccagaaatcccactactaggtatatacctaaaagaatataaatcattctatcataaagatgcatgcaagcatatgttcattgcagcactattcacaatagcaagggcatggaatcaacctaaatgcccatcaatggtagactggatatagaaaatatagtacatgtataccatagaatactatgcagcataaaaaaaatgagatcatgtcttttacgggaacatggttggagctggagaccattatcctcagcaaactaatgcaggaatagaaaaccaaatactacatgctctcacttacaagtgtgagctaaataatgagaacacacggacacaagaggggaacagcagacactggggcctacttgagggtggagggtggagggatggagaggatcagaaaaaataactattgagtactgggcttagtatccgggtaataaaataatctgtacaacaaacccccatgacataagtttatataacagacctatacatgtacccctgaacctaaaaaaaaagtttttttttaaaaaagcccagttatcttaaaaaaaaccctctcccttttttactctccccctatattttgaatttttgatgtcataatttacacattttaatattgcatatctctaaaattattgtagttatcatttttaatagtttgctcttttaacctttatactagagatataaataaattacagatcaccattataatattagagtattctaaatttgactgtgtacttacttttgccagtaggttttatactttcagatgtttttatgttaatagtgtccttttcttacagctcgaagaacttcttttggcatttcttttaagacaggtctggtggtagtgaactccctcagcttttgtttgtctgggaaagtctttatctccccttcatttctggtggatagctttgcgggatacagcatccttgcttggcatttatttctcttcaacactttgaatatatcatcccactggtctgtaaggtttctgctatgtagtctgcttctaggcatattggatgtcccttgtatgttattttcgtcatttatcttcctgctttcaggctccttttttcatcttcaagctttgacggtttgattataatatgtcatggggtacaatatgccttggggtaggagtagtcttatttgatttgaatcaggtttttgacctttctttacctgaacatttatttttctccaggttttgaaggttttctgctatagcttctttaaataaattttctaccccctttgtctttctctatttcctttttaactcaaaataactcagacctttgcttttttgatgctgccgcataaatcctgtaagctttctttattccctttcattcattgttcttttttctcctataactatgtattttcaacaacctgtctacaagttcacagattcttctgcttaattaattctgctctagatgccttctattgcatttttctttttgtttattgtatctttaagctccagaatttgtttaattttttttattatttcagtctctctgttaaattgttcagtgtggtcatttactgttttcctaattttgtttaattgtttctctgtagtttattgaagtttgctgggcttcattaaaatagtatttttaatctttgtcaagtggttcatacgtttccatctttttggggttggtcactggaactttattttgtcactttgatattggtctttgttttgttttgttttttcatgtttctctgattgttcttgattcttgtggtcatgcataggtgtctgcacattgaagaagtacttatttctgtcttcacagtttggctttgtctgggaatgcccttcacagaatgcctgtgattgcagagattctgggtaggtctctagcatgtttgctaagtctgtgatcactgcaactgttgcagtgctagggagtaccctaagcccagaactgctgtggttggcacaatgctgagttggaattgtctggctgctgaggctggcataccatgtggcacagccaaagtctacagctgctgaggcctgcctgctgccgaagtctttctgagatccaaggccattgtagtcagccagctgtggtacaggccagagattgaatccatttcacggggactatgggttcccacctgacactggggctcagtccagggtataagactgcatttagggacgatgagggtctgcctggtgctgggtttttctgtggtagtctcagtgttggggaccaaggcaaagttcgatgttcactttcctctctttctcctaagggaatggtatctctctgtgtgccgtgttgcctgggattggggaaaagatgacacaggtaatataaagctgttccttctaccctcttcagtgtgtctttttttattattatgctatagccatatagctcttgtaaaggtatttttgtgtgtggatagttgtttaagtggattcttctgcaggacaatgattgctggagagttctattctgccatcctgctctgtcctttccaatacttttttggaaatcagattaggtaataaatttagtagaaagtgaaatcttctacatacatggggcagagagggagaagaatctaggtatttaagagaatgaaatcttgcaagaattaaaataaatttcagtagtaacttttaaaggacttctcaaacttaaattgttgcttttcttttccctaaaaccctttggtataggaccagaatagaatgtacagatgggtgcctaatgtgtgtttttaacgagatttatattgatgatgatacatatgctattttatgaaaacacatgggataggtactaaagcgtggcaaggggtgttttaaacaattattagcaatttagatagtaatctcaaggacaatttaaaatttatgtttttattattgtataaaaaggatttaaaggcaaaaatgaagacagtgtcatctctctacaaggacacagatgtgcatgtgttttcttttgcttctttgtaaagaggtcattaaacaatagattttgcaaactccaaaaaggtttaaaatgcttattctacaaaaaagtttgacatattgagcctgaaaagcaactaattcctagacaagtgggtttaatatgaataaatatttgtggctcaatgctcacttaggcttgttacaaaatgtggaagtaactaaatatgattgcaagttttgctgtggtgtattacagtaaagcctcatgcaaaccaaagatgaatacattaggtaaaataattttaagtccatgaaattgattttattaacaagtttttcagtactaatattatgaaaattgataataatgaaaaatatgaagtcagtaccttggactttgaatcttataggacatgcctcagggcttcttctgttagctctgaaactttgcaaactacttacttgcctctacacaaaacatagcaaaagaattggaaacatgtgagtccatgtattcattcgttcatttgaacattcagttattcatttatttaaaatccattcatggttgggtgcagtggctcatgcctgtaatcccagcactttgggaggctgaggcctccatggtggatatgtgccacattttcttaatctagtctatcattgatggacatttgtgttggttccaagtctttgctattgtgaatagtgccacaataaacatatatgtgcatgtgtctttatggtagcatataggaggatcacgaggtcacccagctaacacggtgaaaccctgtcgactaaaaatacaaaaaaattagctgggcatgagggcgggtgcctgtaatcccagctactctggaggctgaggcagaagaatcatttgaacccaggaggcggaggttgcagtgagctgagatcatgtcactgcactccagtctgggcaacagggcgagactcctgtctcaaaaagaaaaaaaaaaaatccattcattcaacaaatatttcttgaatacctcctacatatcagtttttttcccaatttgtttttttttcctaatttttttactattattatactttaagttccagggtacatgtgcacaaagtgcagatttgttacataggtgtacatatgccatgttggtttgctgcacccatcaactcgtcatttgcattaggtattcctcttaatgcaatccctccccctgcactgcaccccacgacatgcccctgtgtgtgatattccttgccctgtgtccaagtgttctcattgttcaattcccacctataagtgaggccatgcaatgtttggttttctgtccttgtgatagtttgctgagaatgatggtttccagcttcatccatgtccctgaaaaggacatgaacccatccttttttatggctgcatagtattccatggtgtatatgtgccacattttcctaatcaggtctatcattgatggacatttggcttggttccaagtctttgctattgtgaatagtgccacaataaacatacatgagcatgtgtctttatagtagcatgatttataatcccttgggtatatacccagtaatgggatggctgggtcaaatggtatttctcattctagatccttgaggagtcaccacactgtcttccacaatggttgaactaatttacactcccaccaacagtataaaagcgttcctatttctccacatcctctccagcatctgtcgtttcctgactttttaatgatcatcattctaactggcatgagatggtatctcattatggttttgatttgctttctttgatgatgatcaaaatacccatgatgatgagtatttttttccttcattttatatctgttggctgcataaatgtcttcttttgagaagtgtctgttcgtatcctttgtttactttttgatggggttgtttgttttttcttataaatttgtttaagttctttgtagattctggatattagccctttgtcagatgggtagattgcaaaaattttcacccattctgtaggttgcctgttcactgtgatggtagtttcttttgctgtgcagaagctctttagtttaattagatcccattgtctattttggcttttgttgccattgcttttggtgttttagtcatgaagtctttgcccatacctatgtcctgaatggtattgcttaagttttcttctagggtttttaggtttgtaggtcttacatttaagtctttaatgcatcgtgaattaatttttgtataaggtgtaaggaagggacacagtttcagctttctatgtatggctagccagttttcccagtaccatttgttaaatagggaattctttcccgatttcttgtttttttcaggtttgtcgaagatcagatggttgtagatgtgtggtgttatttctgaggcctctgttctgttccattggtctatatatctgtttcggctccagtaccatgctgttttggttactgtagccttgtagtatagtttgaagtcaggtagcgttgatgcctccagctttgttcttttggcttaggattgacttggcgatgtgggctcttttttggttccactttaaagtagtttttttccaattctgtgaagaaagtcattggtagcttgatggggatggcatcgaatctataaattaccttgggcagtatggttattttcacaatattgattcttcctatccatgagtatggaacattcttccatttgtttgtgtcctcttttattttgttgagcagtggtttgtagttctccctgaagaggtttttcacatcccttgttagttgcatttccaggtattttattctcttggaagcaattgtgaatgggaattcactcgtgatttggctctctgtttgtctgttaatggtgtgtaggaatgcttgtgatttttgcacgttgatttggtatactgagactttgctgaagttgcttatcagcttaaggagattttcggctgagacaatatggttttctaaacagataatcatgtcatccacaaacagagacaatttggtttcctcttttcctaattgaataccctttgtttctttcccttcctagattgccctggccagaacttccaacactatgttgaataggagtggtagcagagggcatccttgtcttgtgccggttttcaaagggaatgcttccagtttttgcccattcagtataatatcggctgtgggtttgtcataaataactcttattattttgagatatgttccatcaatacctagtttattgagagtttttagcatgaagggctgttgaattttgtcaaaggccttttctgcatctattgagataatcatgtggtttttgtcattggttctgtttatgtgatggattacatttattgatttgcatatgttgaaccatccttgcatcccagagatgaagctgacttgatcatggtggataagctttttgatatgctgctggagtcagtttgccagtattttattaaggattttcacatcaacattcatcagggatattggcctgaagttttctttttttgttgtgtctctgccaggttttggtatcaggatgatgctgacctcataaaatgagttagggaggattccctctttttctgttgattggaatagtttcagaaggaatgggaccagctcctctttgtacctatggtagaattcggctgtgaatccatctggtcctgaactttttttggctagtaggctattaattattgcctcaatttctgagactgttattggtctattcagagattcaacttctttatggtttagtcttgggagggtgtatgtatgcaggaatttatccatttcttctagattttctggtttatttgggtacaggtgtttataatattctctgatggtaatttgtatttctgtgaggtcagtggtgatatactctttatcattttttattgcatctatttgattcttctctcttttcttctttattagtcttgctagtggtctattttgttgatcttttcaaaaaaccagctcgtagattcattgatgttttgaagggttttttgtgtctctgtctccttcaattctgctctgatcttagttatctcttgccttctgctagcttttgaatttgtttgctcttgcttctcgagttggtttaattgcgatgttagagtgtcaattttagatcctttctgctttctcttgtgggcatttagtgctataaatttccctctacacactgctttaaatgtgtctcagagattctagtatgttgtgtctttgttctcattggtttcaaagaacatctttatttcttccttcattttgttatttacctagtagtcattcaggagcaggttattcagtttccatgcagttgtgtggttttgagtgagttacttaatcctgagttctaatttgattgcactgtggtctgagaaacagtttgttgtgatttctgttcttttacatttgctgaggagtgctttacttccaattatgtggtccattttagaataaatgtgatgtggtgctgagaagagtgtatattctgttgacttggggtggagagttctgtagatgtctgttaggtccgcttggtgcagagctgagttcaggttctgaatatctttgttaatcttctgtctcattgatctgtctaatattgacagtggggtgttaaagtctcccattattattgtgtgggagtctaagtctctttgtaggtctgtaaggacttgctttatgaacctggttgctcctgtattgggtgcatatatatttaggttagttagctcttcttgtttaattgatccctttaccattatgtaatggccttctttgtctcttttgttctttgttggtttaaagtctgttttatcagagcctaggattgaacccctgcttttttttttttttttttttttttttttgctttccatttgcttgatagatcttcctccatccctttattttgagcctatatgtgtctctgcacgtgagatgggtctcctgaatatagcactgattggtcttgactctttatccaatttgccagtcttgtgtcttttaattggggctttagcccatttacatttaaggttaatattgttatgtgtgaatttgaccctggcattatgatgttcgctggttattttgcccattaactgatgcagtttcctcctagcattgatggtctttacaatttggcatgttttagcagtggctgctaccagttgtccctctctatgtttagtgcttccttcaggagctcttgtaaggcaggcctggtggtgataaaatctctcagcatttgcttgtctgtaaaggattttatttctccttcacttatgaagcttagtttggctggatatgaaatcctgggttggaaattcttttctttaagaatgttgaatattgacctccagtctcttctggattgtagggtttctgccaagagatccgctgttagtctgatgggcttccctttgtgggtaacccgacctttctctctggctgcccttaacatgttttccctcatttcaaccttggtgaatctgacaattatttgtcttggggttactcttctcaaggagtatctttgtggtattctctgtatttcctgaatttgaatgttggacttccttgctaggttggggaagttctcctggataatatcctgaagagtgttttccaacttggttccattcttcctgccactttcaggtacaccagtcaaatgtacatttggtcttttcacatagtcccatatttcttggatgctttgttggtttctttttacccttttttctctaatcttgtcttctcactttatttcattaatttgatcttcaatcactgatatctgttcttccacttgatcgaatcagctattggagattttgcatgtgtcatgaagttctcatgccatggttttcagctccatcaggtcatttaatgtcttctctacactgtttattctagttagccattcgtctaactttttttcaaggtttttagcttccttgtcatgggttagaacatgttcctttagctcagagaagtttattattaccgaccttctgaagcttacttttgtcaactcatcaaagtcattcttcatccagttttgttccattgctggtgaggagctgtgatcctttggaggagaagaggcactccggtttctacaattatcagcttttctgctctagtttctccccatctttgtggttttatctacctttggtctttgatgttggtgacctacagatgaggttttgatgtggatgtcctttttgttgatgttgaagctatttctttctgtttgttagtttttcttctaacagtcaggtccctctgctgcaggtctgttggagtttgctggaggtccactccagaccctgtttgcctgggtatcaccagtggaggctgcagaacagcaaatattgctgcctgatccttcctctggaagcttcatcccataggggcacccgcctgtacgaggtgtctgtcagcccctactgggaggtgtctcccagttagactacacaggggtcaggtacccagttgaggaggtagtttgtccattttcagagctcaaacaccatgctggtagaaccactgctctattccaagctgtcagacagggacatttaagtctgcggaagttgtctgctgccttttgttcagctaagccctgcccacagaggtggagtctgtagaggcagtaggccttgctgagctgaggtgggctctgcccagtttgagcttcctggctgctttgtttacctacttaagcctcagcaatggcggacacccctccccctgccaggctgcagccttgcaggtcgatttcagactgctgcactatcagtgagcaaggctctgtgggtgtgggacctgctgagctaggcacgggagagaatctcctggtctgccagttgctaagaccatgggaaaagtgcagtatttgggcagaagtgtaccagttttccaagtacagtctgtcacagcttccctttgctaggaaagggaaatcccccaaccccttatgcttcccgggtgaggtgatgccccgccttgcttcagctcaccctccatgggctgcacccactgcccaaccagtcccaatgagatgaaccaggtacctcagttggaaatgcagaaatcacgtgtcttctgtttcaatcatgctaggagctacaaatcatagctgttactattcagccatcttagaatgaaaaaaaaaaaactcctaatttctttttacccataaatttaaggaatacacatcctgaaaacataattcaaaccccatcaattattttgaaattcaaaataattcaataattttttaaaaattcaaaatagttttaaaacatctaaaggcaaaaactagtcttcctcatttttcccaatgtcattgcctttgccataactaaaaaaatatctggatcaggagtcaataacctgaaggaccgaaggctggattttgtttttgcgcattatgtcaaataaatttttctttttacatttaaaaggtttgttttaaaaagaagaaaaataagatattcagcagagaccaatgtgtggcctacgaagcctaaaatatttatagtctggccctttacagaaaacaattttgaccactggtgtagacttctagacccttttctgggtatgcatctatacacacacacacatacagaaatctatagtttgttttttgatttgtttatagatgtaagattttatttgttcattgtcctgtgaggtgctttacttaatagtgtatttgtatatatgtatatagcatatttgtagatagtttcatgtcagtattttttttttttttagatggagtctcactctgtcaccagactggagtgcagtggcacaattttggctcactgcaacctccaactacctggttcaagtgattctcctgcctcagcctcccgagcagctaggattatgggtgtacaccaccacgttcagctaatttttgtatttttagtagagatggggtttcaccatgttggccaggctggtttcaatctcctgaccttgtgatctgcccacctcggcctcccaaagtgctgggattgcaggcatgagccactgcacccagcctcatgtatttttatgtcaactgcttatttttttacctcctaagtagcagtttatacatatgtttcctgcctctataaagccattgcccctccccactttggagcaacatcttctctgaaaaatcttacacacattttcagtttagttctcagctgtgtgcctctgtcttccattttaaatattcatccattcatttattctttctaaaaatatttattggcacatactatgtgccaggtactcttctagaccctgaggattcagtgggtttttttttgtaaaaataaaagaccaaaattcctgcccttgtagagcttactttctagtaggagaaacagatgacaaatagaattactaataatacatgaaatgtaattggaggcaaagaaaggcaatatgaagtgacagttggtaagggttgaaattttaggtcaggtgtcatacatagcctcagtgagaaagtgacttctgagaaaagatcctgaggaaatgagggtgctagccattagaatatctgagggagaacactatggacacgtgcaaaggcctcaaggtacatgcatgcctggtgaacctgaggaagacaaaagatagcaggaagatcaatatggcagaagcagagtgaatgaggaaaagagtagtggaaagggaagttagaaagggaaggaggacccacagtttatgggaccggtgggttacattaaggactttggtttttactccaagtaagggatgagaaccttgggaggatattgagtagaagagtgatatgatctgatttcctttcaataaaatcactctggctgctttgttgaaaatagatcaaaggggcagaaggacagaagtagatgcagctagacaagttaggaagttgtgatggcaatccaggtgagacatgatggtggcacagaagggaggggtggacatagaaggagtaagaaatggacactataaaaagtacacaagaggggaaagccactcttgagattgaggcatattgatcaataggtaattccctcttgtttcaaaaatgatgaaaatgtgttacaagtagaaccttcagatctcagggaatggccaaggtcagcctagcaaataaatcttagtgtctgagatcaatcttacatggaacaaacacccttaaggtaagggttcattcattattttaagatcaagaccatgttctcatgaagtgtcatcttagaagtttagttgtaggtctcactgtaaaaccagtcaagctgggagaagaaaattacatttctctttgcaactgctccaagaaagagtctaatcatacctgcatttttaaacagaaaaatagagtctgagtctaggccaaagaacaaagaagtttccagagagcagggatttttggcagcagacgtgaggtgagtgagaatagaccctaaggaaacaaccagctgtggtcataccaggctctttgtcagtcccctggaggctgattttcagcagactgggacagctctactggtctctcaggagtcttgttgactccctgcagctatcaaaggaggccatatatcggtatctctctgcttctcaaatgagagaagcatttttcttttctttatccctgcaaatcccagaaaattgaggtaaggtctggagagttgaaatgccttctcagaggcatagtgccagggattagttctaactcaagagtctcagagacagtgagacaggggatggaaaggaagaggagagaatctgaaacccagatggtcttatgactttattaaagctttccctacctttgcatcataattatgttggatatgcaaactgggattcgcatatgctaaggtatataaaatcattatttctttaatgagacacacagtgagtttggaggatgtcaggacaatgttgtttaattcctggctccaaggaaaagaggaagcccaagatatgtttcaacctttggaagaaaaaaactctactactaatactgttatattgattggttcttttgatgacaaatggcaggaaaatgataaaaactgactcaaaatagaatgtattggctcatctagctgtaaaatataaaaatggacccatggcataatcaagacatttacacactgggcatagcagattccagggggctcagatgatagtggttgcctttctttctctaattttccattctacttccaatatgtgttggactcattttattctcctgccatgtaattggaaagatgacaaccagaagtcccatgtatacatcatttttcttataatttgttatccaaacataagaggatacacctccatagttccagcagaaaggtccaaagagaactttggcttatctaggttaaatatctattgccacacctgtcgctgcagccagaggggtggggtttgttagccagaactggattacatgctcatccttgggctcatggagcaagagcagccacccacgaaaccattcagaaagtgggagggataattctccaaagaaagtagaattaaggagtaaaaatatatgtctgctataatcatatttcttgtttctaggaggaacatatcttcttagaatacccacaattttgtgtttccaaacaatgtatgtgtacatattagtagcataactttcaagctagtattttaaacttcttattgaagtgtaatatgcatacacacagacagataactccacatttatcagggtacagtttgatgaattatgtggtagtattacatttcttctcataaggttgagaagtgtttcctatcttcaaaaacagctatacaggctatagcttaaaggagacaatagtttggtggaaatatatggatgaaatattcaagaaggtagatttgaggagcaggacaatgggaactaaatgtctgcagctcatggactaacaaagcttaaaggtaagctggccctgtaacttaccaagcatggttttccaccatttgtgtttggctttgggtctagctcatgtacgacagtcctggtcaccaagtatttattgagttgaaccattggcttaataagagaaaagctccaggcaactggttatctacaggtgtatggggaaatgctaccaaaaagctaagtctgttctggtgtggccagcttacatgtccatcatatagtagtacctacatacctgtggttttgctttctatggtctaaaaatattaaatgaaaaaattccagaaataaacaattcataagttttcaatcatgtaccactctgagtagcgtgatgaaatctcattgtctcactctgtccttcctgggacatgagttcccctttgtccagtttctccatgctatatccctacctgcccattagtcattgacattattcactcccaacatccaataattgacatcgtcatggctcagtgatccaggatcacctaaaacagatgatcctccttctgatgtatcatcagaaggtcaatagtagcctaacgctccatcacaatgcctatgtcgttcacctcacttcatctcatcacataggcattgtgtcatctcacatcatcacaagaagggtgactacagtacaataagatattttgggagagagaccacattaacatagcttttattacagtatattgttataattgttctattttattattatttattgttgttaatctcttagtgggcctaatttttaaattaaactttatcatagttatgtatgtataggaaaaaatatagtatatctgggttttgtatgatatgtgatttcaggaatccactagggatgttgaaatgtatccccagcaggttagcagggattactatacacatatcattagatggcttcatccagctcttttattattaactagggtcttaggagccctttcttactgttagtctagagattaatttcccactccaatgtggtggatatctcagttttgcccctctatgtctactcaccacccatctctgcctcaagactgacttgtatgtatgacatcatcaggtttccttactttctgcctgtcatttgggttcagccaatggagaacatgtgtaggaaattagaaggagggagacaagggaagtcaaggtattaatttcccaagtccctcctgtagggctgccttgagatataatggaccaaatgctgtctattagctaactcttgactagagaagctaacatttcccagctctcaaagtccataattccatatttctccttttttcccctatttatttatttttcatcttatcctacctgtttcagttttaggcatcacaagtgtcttcccttgcctttgaagtcacccctcaatttcttttggtctcatgttatcaacctcagattcctttttatttttatttttattttaagttctggggtacatatgcaggatgtgcaggtttgttacataggtaaacgtatgtcatgatggtttgcttcatctgtcaacccatcacctaggtattaagcccagtatacattatctatttttcctaattctctccctccccccaccttactccctgacaggccccagtatgtaatcaaccccagattctagaatgtcttttctttttctgatatctgggatgtggaaattttttatgttcaagggtatgtaactgaaggtgtgctaatctccttaataatctcttataaaggatgtttcatatgattatcacaacctgaagtcttccccaatctcctatctcatccactccacaaaaagtaccagagttgatatcacaacatcttctgcacccagcaaggcatgtattttctctgatgccattttagaatgcaaaagcttattatatttatttctgataccaagacaaacaaatctttgacatcagcaacagttatgatagggttcatttctacccaacaaacttaactggctgtatttttagaatgccaacatccacagcgcttcactggctcatcaatggctattagttcatccgtcgaatggagaggagggcataaattcatagcaataaagacattcggtggttaaatagtctctagcatatgtgactgctagattgaagaatgaacttgcagagaaactattatactggaaacttgctctggtacagttcaagaagaaataacattaatagatagagtgagagtattttatggagcctaatttagtctctaaggaccgaaggacctcattagtatatgccttcacttatgaaatggcttggaagagacagaagtgaaaaattacgcagtaggtaaaacaataacccctggcatcagaaagacttggacttgaatcctctctctgctccttgctagttagttgaccttgggctagccacttaacctttttaagtacacattctcttctgtctcttgggtctaataatataccaaggtataagattcttggggtcactaaattagataacctttgaaaagcagttattacagtgccagacacaaactaagcactcaagaaatacttgcattttgtttctgaagctagggtctgaaatatatgtctgctatagtcatgtttctaaattctaggaggaacatatcttcttagaatacccctatttttgtgtttccaaactacacatgtgtacatattggtagcatcactttcaagctaatattttaaacttgttattgaaatgtaatatgtatacatacacacagataactgcacatttatcagtgtgcagcttgatgaattatgtggtagtattacatttcttctcataaggttaaaaagtgtttcccatgttcaaaaacagctatataggctagcataaaggagacaatagtttggtggaaatgtattgtttctgaagatagggtcctattttatttctgaagataggctcttgctccatcactcagtttggagtgcagtggcatgatcatagctcattgtagcctcgaaaccccaggctccagtgatccttctgcctcagcctcccatgtagctgggacgaaagacgggaaccactgcacctagcccaatacgttaatttagataatggaattttgatgataatgatcacttgcaagaccaatgggtatttaacattatttccctcaaacaagcttctccatccctatactttttatgaacaaaagagccatgtctctaaatacccaagttcatcgtggctctcactcttttaaagattgctcctgcctttctagtcaacagagtagagtttaaactccttaagatagtatataaggtattcacaacttgttccagtctcacctcttcagcctcatatctggcttctttgcatcctccatgtcttactgccgccagagcaaaattttcactgtacgccacctggtcataatatcatgccatgcatatactcttccctttgcctggaatgtccctgtggagccctcaaggctctggccaagggtcaccttattagcttatatttattaagtgcgtgttgtgtgcccagcatggtgatgatcaacactctatgatgtagtattattcagcacaagaaggaatctaaggcttggcaaaatggagctcaacaaagtgatacacattcaaggatttatgtccatgaagtggcagagaaatcaaggtgctctggctccaaagttgctatatttatttcctatcaagctgtgacaaatcatcacaaatgtagtaccttaaaacaacacaaacctattatcttacagttctaaaagtcagaagtccaaaatgaattatactgggctataataaaggtgctggcaagactgccttccttctggagttctaggggataatctgttttcttgacttgtccagctgctagaggctgcccacatcccttcactcatggccctttcctctactaccaaagccagcagcattacatctcaaatgtttctttttctttctctcattccttctcccaccctcttcctttcccttcctttctcttcctctctatgactttgcttccatcatcagatctccttctctaactttgaccttcttgcctccctcttataaggatgtgtgttattaccttgggcccgcctggataattcaagataatcccagtgttcttaatgtatttacatctgcaaagtccttttcaccatgtaaggtaacatattcacaaattcccaggattaggacaccgatctctttgaggagtctactacattaattctcttgacttctatattatttcgtcaactttctcttggaaagttgccttctctaaattttccatgaaaatttccacagacaagtagctacccatttccttggattcctcccataactctttattcatacttcttttgtactcaccatattgtactgaaattaatacttcatatttctggctccccccaattgaatgtgagctcctctggggcaaaactcttcagcacccagcctagaacaggaattcacagggagcatttactgaaagctgggtagacaagtggatggatggaaggatgaaatgtgtaaaaatcatggtcatccctaagatgatggccttagtagccattttaaacaaatacattaatttagccaaaaagatgttaccaaagtttatacatgtcaggagtgaaaactgttctgcaagaagtgagaatgactctttctgttgatgcttgatttcttaattcaggcaacactcagatgctatctgcctactaactgctgggccccagggtcataaagataaattacagtcttaccactgagtaactgacatttttaagcacagacatatatgaactcaacaattatacaatagtaatatatgctactctcgcatctgggagaaccatttgtcaggtcttgttggaagccacacagactctttgcaaaaccgtgcttctgttaaagagagagagaaagaaacagagtggggtggggaagggaggaagagagagaaacctgtgttgttagtgtttctgaggaggcagagtctcttagtgattaaagacactcattagaaagccagagacttgggatgaagccccttctctgccatacagaggtcatatcatttaaatgacctaactcaatctcaaactcttcctcagggattatgagctcacctgtcctatagagatttgtgagaagtagatgagaaaatgttttaaaagagctcaatataacacctaatgcattctttgcatccaagaaatgctaactataattattatttttgacaactatttgcctttctggatatcatcaacaacccatttcttaatgtgacataataatatttcaaagtgttaattgaagtactacttactacctcccagtgtagctgctcaccatccatctttgacacccaaatggatgaacacgtattgcagaagagacagtccgcagctaagtgtgacatccttagcctccaaatggacaaacaagtaaaaaaaatgttttcttcctgccccaagactctacaaaagatcctctgagctgcagatggacaaaagaatttagattacaagagaaaagacacagtaccagggtgatttattctatcatctctccctggaataaatcctatgatggagagggaaaactgcctcacaatggcttttaatttgggaacctgataatagaaaggattggacctctgtctattctgtttcaaactatggtcattggtagtcatatagagctgggagtaaggggttagggaagagtaattctgcaactcctgtggtgctcctaaagatgagggacaacaatcaaccctataggaaagacctggaaggactgaaattgggctgaaaaatctgaataagcctggataaaggacctggagggtggagaataacctaaggacctgattatcaaagctagggcaaaatcttgaacatctcagagggcagagcagctaaaagtcaatggccataagccatgaaggtcaagtgccagcatagaaagtgtagcacactcaagattcatacaagacaaattacatatttaaaaactctagcaaaggaccaagatctggatttggctcctcagtggcattgcagaaattgtcttagtcctgaggcatttaaaatcaggactgaattagagggaagaagaaaatctcaagatggcttgtatgatcttctgaatggtaatgagtttaaacccagaagtagcctcatgaaaatctctagactggactgaaaaaatcctcaaaaaaaactgaattaactcttctctcagaggggaccaatgagtcaaaaaatcaaagagttttgtagaagtaaagttaatttttgcacaacttagattgtcacttaaggttcaaaaccaatcaacatttgcctttctcattctctccagctgtatatgggcaatttcactgaattaatcacacttgtgacaactgtgtttagaagcactggagttgcattttgtattaagtatattccattagtggggccatgggtactgagttactgaaaagattagctgcaaggttgtgagatttaatatatagttcttgcttagggaagtatgacaagttgcatctgctaaattaattgccatttgctcaggtgatacccctcagatggggatagctatgaaggaacagaaaacgagaatgaggagttgagaataacaattcttcgtgtgctgacttgggatctaggaaacagcttctggaaataaaagtggttagtgtcaaacaagagttggcaaagtttgtctgtagaggaccagatagtaaatattttaggctttgtgagccataaggtctttgttgcaactgttttacttcaatgttagagcatgaaaatggccatatacaatacataaaggagcatggccaggttccaataaaacttttttacaaagaacaatcagcagctggatttggcccatagggccacagtctcccaacctctggtctagctcatctgcactaaagaagatctgtctgttcattagtcataacatctggtgcccaaaatttgggtatgcagatatacttgcctgatgacaatgtggcagagatgggtaatgttggcattgttggttttgttttctgggctacttgggatctatttctcttgacatcctttggtccacacactttttcttgagctggactctgggccctatgggaaaagagtgtgatctaaatctaaccaatggtcacactaatccccctagccacagtgactggtgcagagataggacgtggtcccaacttgtccaatcatgataaggtgtgcatcatgttcaaccaggaagaatctcccagcagtagaaccgagacaaacatttcagtgtaaatggtttatttgagaagtgatcccaggaaatgtgatagagaaggaagaagaaaggccagccaataaagcatgtgttaccatcaagtaagttacaactgaggggattgtagcttaatccttctgggaaactctgggagcccatgtagaacaggagcctcagagttagcctgacacaagagtggaaactaactcttgtcagtcattggtagagggctgctcctaggagtgttaattccctgatacttctggtctgccctgagcattagcagagtaaatgttttagccactgaaggatgacttcaggcaaagacatacagatgctaggttttgaaagtcagggcccactgcactaaaaaagagtccaaaaggggatgtgggtgggatagctactgcatttgctacactgaatttggttagtctccctattggagctctgaagaaactaggggcttatttgactcaggttgagtctctgaatcatactgtgactgaagtaatcccatagacattttagttacatgcacaaacaaattttctttttgtttaaaccagtttgagtcaagtttcttaccctacagatccacaaagactaaataaagcacataggaaattggaatttattttctactggtattgattcatcatacaatctgataaatattttagaatatatacaatttctgtatgtatataagaactcatatataaaatgtatttgatctacatcttacatctatatcatccatatctgtgtctacacctatatctgtatataggcatgtggaaagaggtacaaaaatatgtttgttcttaatcatgcacagatagttaaataagaatataaacgagggtctcaggaaatggcagtcagatccccacaatctttccatttatccacaacatgcaagccatgaatatctgctttggtgaagcaaagcaattgtgcattgcccggcagactctcagcagctgtttaataaaaaagacaaatgtctatttctcatgagaacttatttttgtccacaacctctgtgcttgaggtttatctctttttttcattcttcacactcttatttgctaaaaggaattaaaggattagaattgagatggtatggacaaatagaaggggatcagaagataataagacgaggaaaatcaaatgtagtcatttcagagaaagtcaaagagtcaagggagtgagcaaagggtggcacatgcttataagaatgggagaggtgtcaaaaaagagattaaaagataaaattccaatgcctaaagcatgtgttccctcctttttttgtcctctgaggaaataaaacttatttctattatagttttgttcagaaggctatttcaatcaatgccattctatgctgatacatgcttacatggcctagataaacatatgaaacccttgtgaatcttggatccatgtagttcagtctatggcatcttattcaagaggcatagttcaacagtctagaaatagattaagatgaattccttgcattcattcaacatttccgttgaacattttctatgccagccactattctagggactagtgattcaataatgaacaaatgaaacaaaagcacgacctcgcagagtttacattgaatggggaagcacagatgataaacagaataaataaaatgtatgataactaagatagtgatagctgatatggaggaaaacagcaggaaagaatacttgggagggggagcttctttgagatggtgacttttgatcaaaaacctgaaggaggtaagggactgagtcatgcagacatctgagggcagaatatgtcagacagggaacaggaagtgcaaaagccctaaggtgggagggtgctaggcctggggggtgctcagaactgcacaaaggccggtatgagtctcgagcagcggtcagcaaatgttttctgtaaagtaccagatagtagaagattttcagctttgagggccatatagtctccatcacaacaactcagctctaccagtggggtatgaaagcagcaggacaatacgtaaatgaatgggcgagactgctccaatcaaactttatttacaaaatcaggctgtatgcctatgggccatagtttgtagacccctggactaaaggaatgaacagggaataataaggcctgaagatgcacggcattatacatcattgtaaccaccttagttttgttttgttttgaagacagggtctcgctctgtcacccagactggaatgcagtggcacaatcgcagctcactacagccacaacctcccaggttcaagcaatcctcccacctcagcctcctgagtgactgggtccacaggtgcgtgctaccacacgcagctattcttttttttttttttttttttggcaaagatagggtcttattttgttgccaggctagttttgaactgggctcaagcaatcctccagccttggatgcccaaagtgctgggattacaggcaagagccaccatgcccaatgactttgtgtattagtctgggttctccagagaaacacaaccagaagggtgtgtgtgtgtgtgtgtgtgtgtgtgcataaaatgagaaattggctcacatgactggggccaacaagtccagaaatctgcagtcagcaagctagagaaccagaagagttcaccatgtagttctagtccatgtcctgagaaccagaaaagctctactccaaaagccaaaagccaagaaaagctgatgtttcagtttaagtcttaacccaggaaaacacaaatgtcccagctcaaacatagtcagaaaggaggaattgtctcttctttctgggagggttagcctttttggcccattcaggccttcaaaactgattggatgaggcccacccacattatcaagggcaatctactttactcagtctactgatttaaaggttaaacctagccaaaaatgtcctcacagacacatccagtgtaatatatgaccaaatatctaggtaccccatgggccagtcaaggtaatacataattattttttcaccaacaagtaaacattgtttatatttgtggtgtacagcataatgttttgatatatatatatacattgttgaatggctaaatcaagctatttaatatatgcattccctcacatacttatttttgttgacaggtatgtggttgtaagtatgtaaattggcagtgagaacacttaacatctactctcttagcaattttcatatgcaatacattgttattaactgtagtcaccgtgatgtacgatagatctttcttattccttctaatggaaactttgtgtccttcggtcaacatctctccaattttcccaccttctagcctctgatgaccaccattatactctgtttcaattagtttgacattttagattccacatataactgaggtaatgggtgtttgtctttttgtgcctggctcatttcagttaacataatgtcctccaggtttatccatgttgtctcaaatgacaggatttctttctttttgaaggctgaataagtactctgttgtatgtgtgtgccacatgttgtttatccattcatccattgatggacagtcgatttcctattgtgttagatcatttttgcattgttataaagaaatacctgagactgggtaatttatcaagaaaagaggctcacagtcctgtaggctgtacaagcatagcaacaacatctgctcagcttttgatgagggcctcatgaagtttacaatcctggcagaaggtgaagtgggagcatgcacatcacatggcaaaaggcagagcaagagagaaggaggaggtcctagactttcaaacagccagctctcatgtgaactaactgagcaagaacccacttattgctgaggcgatggtactaaatcattcatgaaagaactgccccatgatccagtcacctcccatcaagtctcatcttcaacattgaaaatcacatttcaacatgagatttggaggggacaaacatgcaaataatatcacctatcttagctattgtgaataatactgcagtgaccattggaattcagatatcaacttgacacactgatttcatatacttagaatatattcccagtagtagtattgctggattgtatgatagctctatttttaatttttgaggatcctccatatggttttccataatagctgcaagaatttacattcacactaatagtgtacaaagcttcccttttctccccaacctcgccagcacttgtcatctttcatcttttttataatagctattctaacaagtatgagttgacatctcattgttttaatttgcatatatctgatgattagtgatattgagcattttttaaatatacctcttggccatttgtatgtcttttgagaaaagtctattcagatccttcacccattttttaattggctgatttgttttcttaccattgagttgtttgagttccttatataatttggatatcatcagacctgaaggagtcatgcctacaaggacgatggccatctgaatgaaacctgctattccagggccttggactgtcacaataactatagcagtattagagtagcatgtggggagagagaatcccaagagtggaatacaggctaggaagcaaaattgttatagaaataagcctgggaggggcccggatggctgaatagaaacagccacagtcagaggctcccaataagaagaatgaaaacagcaagtgaatcctgcatcagcaactgaaatatccaggttctttcactgggactgactaggcggttggcgtgacccacggagatcaaggtaaaacaaggtgcagcgaaggccacctgggagccacatggcacaaggagaactcccacccccagccaagggaggtggtgagtgattgtgctaccccacgcaggaaaccatgcttttttccatggatctgtgcaacccatggatcagatcccctcatgagcccacactactgcagtcttgggtcccaagcacagagctgtgcagattctcggtgaccacttgactggagactgcctaagactaccgagttcctggggggaggggcagccaccattactgcagctccagtatccagttttctcctgctggtgctggagagactgagcagtttggacccaggaggaacttcccacagcacagcacagtggctgtagcagattgtggccagattgcctctttaagctggatcttgacccatccttcctcactgggtgggggctccctgtggtaatttcagcaagtccagccaggggtttacagacagaactctgttctccctgggacggagtcactggaagcagggcagccgcagtcttcatggatcagtggacttagtctttcccactgatggctctgaggaacctgggaattctgaaccagtgggattactcccagcacagtgctcctctgacaccaaggggcagcaagagtgcttcattaagcaggtccttgaccccatgcatcctgactgggtgagactcccccacaggggtcaccagaaaacctacaagccagaagaaattaggggccaatattcaacattcctaaagaaaaaaatttccaatccagaatttcatttctggccaaactaagcttcattggcaaaggagaaataaaattcttttcagataaccaaatgctgagggaatttgtcaccaccaggcctgccttgcaaaagatcccaaaggaaatactaagtataaaaaggaaaaaccattaccagtcactacaaaaacacactgaagtacaaaaaccaatgacactatgaagcaactacatcaagtcagcaaaataatcagctaaaatcatgatgacaggatcaaattcatacagaacaatattaagcttaaatgtaaatgagctaaatgcccccaattaaaagacacagaatggcaagctggataaagaatcaagactcattgttgtgctgtattcaagaaacccatctcacatgcaaagacacacataggctcaaaataaagggatggaagaaaatttaccaagcaaagggaaagcagaaaaaagcaggggttgtaatcctagtttctgacaaaacagattttaaaccaacaataatagtgggagactctaacaccccactgtcaatattaagcggatcattgagacagaaaatttgcaaggatattcaggacttgaactcagctctagatcaagtggacctgatagatatctacagaactcttgacccaaaaacaatagaatatacgttcttctcagcaacacacaacacatactctgaaatagatcacataattggatgtaaaacactcctgaacaaatgcaaaaaaaacactgatatcataaacagtctcacagacaacattgcaatcaaattagaactcaagatcaaaaaactcactcaaaaccacacaactacatggaaattgaacaacctgctcctgaatttctcctgggtcaataataaaattaaggcagatatcaagttctttgaaaccagtgagaacaaagacacaacaacagagacacaaaaaacccttcaaaaaatcaataaatccagaagcccattttttgaaaaaatttataaaatatagaccactagctaggttaataaagaagaaaagagaagaatcaaatagacacaataagaaatgataaaggggatatcaccactgataccacagaaatgcaagcaaccataagagaatactctaaacacctctacacaagtaaactagaaaatctagaagaaatggataaattcctggacacatacaccctcccaagactgaatcgggaagaagttgaatccctgaatagaccaataaaacaagttctgaaattgaggcagtaataaatagcctaccatccaagaaaagcccaggaccagggagattttcagctgaattctaccggagatattaaaagaagctggtaacgtttcttctggaactattccaaacaattcaaaaggaaggactcatccctaactcattttatgaaaccagcatcatcctgataccaaaacctggcagagctacaaaaaaaaaaaaaaaaaaagagagaagaataattcaggccaatatccctgatgaacattgatgcaaaattctcagtaaaatactggcaaaccaaatccagcagcacatgaaaaggtatatccacatgatcaactcagctttattcccaggatgcaagtctggttcaacataatcaaatctagataattcatataaacagagctaaagacaaaaaccacttgattatctcaacagatgcagagaaggcctttgataaaattcaacatcccttcatgttaaaaactctcaataaactaagtattgatggaacataccttaaaataatgagtcatttatgacatacccacaaccaatatcatactgaatgggcaaaaagtagaagcattccccttgaaaactggcaaaagacaaggatgccctctctcaccattcccattctttttttttttttttttcaggatggagtcttgctctgtcactcaggctggagtgcaatgtgcaatctaggctcactgcaacccctgcctcctgggttcaagcaattctccttcctcagcctcccaagtagctgggattacagttgcacaccaccatgcctggctaattttttgtatttttagtagacatggaatttcaacatgttggtctggctggtctcgaactcctgacctcatgatgtgcccacctcagcctcccaaagtgctgggattacagtctccaaggcaatcaggcaagataaaaaaataaagggtattcaaataggaagagagaagtcaaactgtctctgtctgctgatgatataatcctttagaaaaccccatcatctcagcccaaaagcttcttaagctgataagcaaattcaacagtctcaggatacaaaatcaatgtgcaaaaatcacaagcactcccatacaccaacagcagacaagcagagagccaaatcataaatgaactcccattcacaattgctacaaagagaataaaataccaaggaatgcagctaacaagagaagtgaagggcctcttcaaggagaactacaaaccactgctcaaggaaatcagagaggacacaaacaaatggaaaaacattccatgatcatggataggaagaaataatattataaaaatggccatactgaccaaagtaatttaaagattcaacactattcccattaaactaccattcacattctttacagaattagaaaaaactactttaaaattcatatgggaccaaaaaaggagcccatatagccaagacaatactaagaaaaaagaacaaaggtgaaggcatcatgctacccaacttcaaactatactacaaggctacagtaaccaaaacagcatggtactgacacaaaagcagaaacatagaccaaggaaacagaacagagaactcagaaataagactgcacatctacaaccatctgatatttgacaaacctgacagaagcaagcaacggggaaaggattccttatttaataaatggtgctgggaaaactggctagccataggcagaatattgaaagtggacctcttccttacatctgttacaaaaattaactcaagatggtttaaagatttaaatgtaaaacccaaaactatgaaaaccctaaaagaaaatctaggcaatgcctttcaggacatgggcacaggcaaaggtttcctgacgaaaatgtcacaagcaattgtaacaaaagcaaaaattgacatatgcgatctaattaatctaaagagcttctgcacaacaaaagaaactattagagtaaacagataatctacaaaatgggagaaaatttttgcaatctatccgtctgacagaagtctagtatccagaatctacaaggaacttaaacaaatttacaagaaaaaaaaaaaacctattagtagtaaaaggacatgaatggccacttatcaaaagaaggcatttatgtggccaagaaacatgagaaaagcttaacatcactgatcattagagaaatgcaaatcaaaaccacaatgagataccatctcacaccagtcagaatggtgattattaaaaagtcaagaaacaacaggtgctggcaaggctgtggagaaataggaatgttttgacactgttggtgggaatgtgaattagttcaaccattgtggaagacagtgtggtaattcctcaaagacctggaaccagaaataccgtttgatccagaatattagtctgctctcacactgctgataaagacatacctaagactgggcaatttatgaaggaaagaggtttaattgactcacagtttcacatggctggggaggcctcacaatcatggtggaaagcaaggaggagcaaagtcacttcttacatggatggtggcagtcaagggagtttgtgtaggggaactcccccttatacaaccatcagctctcatgagacttattcactctcatgagaacagcatgagaaagacccgggcccatgattcaattacctcccacaaggtccctcccacaacatgtgggaattgtaggagctacaattcaagatgacatttgtgtgaggacacaaccaaaccataacattctgcccctgctcccccaaatctcatgtcctcacatttcaaaaccaatcatgccttcccaacaatcccccaaattattaactcatttcagcacttactcaaaagtccatagtccaaagtctcatctgagacaaatcaagtcccttccacctatgagcctgtgaaatcaaaatcaatttagttacttcctagatgcaatgggggcacaggcattggataaatacagacattccaaatgggagaaactcgccaaaacaaaggggctacaggccctgtgcaaatccaaaatccagtggggcagttaaatcttaaagttccataataatctcctttaactgcatgtctcacatccaggtcacgatgatgtaagaggtgggttcccgtggtcttgggcagctctgctcctgtggcttttcagggtacaacctccctcccagctgctttcatgagctggcattgagtgtctgtagttttccaggtgcatggtgcaagctgttggtggatctaccattctggggtctggagggtggtggctctcttttcacagctccactagacagtgctccagtggggactctgtgtgaggacttcaacccaacatatcccttccacactgccctagcagactttctccatgagagccctgtccctgcagcaaacttatgcctggccatccaggcattcccatacgtcctctgaaatcaaggtggaggttcccaaatctcaattcttgagttctgtgcaccggcaggctcaacaccatgtggaagctgctaaggcttggggcttgcaccctctgaagcaacagcccaagctgtactttggccccttttagacatagctagagcagctgggatgcagggcaccaagtccctaggctgcacacagcatgggggccttgggtctggcccacgaaaccattttttcctcctaggcctctaggcctgtgtgggaggggctagtgcaaagatctttgacatgccctagagacattttccccattgtcttggtgattaacatttggctcctcattacttatgcaaatttatgcagctggcttaaatttctcctcagaaaatgggtttttccttttctatcacatcatcaggctgcaaattttccaaacgtttatgctctgttttccttttaaaactgaatgcttttaacagcacccaagtcacctcttgaatgctttgctgcttagaaatttcttctaccaggtaccataaatcatctccctcaagttcaaagtttcacaagtgtctagggcaggggcaaaaccccaccagtctctttgctgaaacatagcaagagtcagtcatcattactccagttcccaacaagttcctcatctccgtctgagactacctcagcctggatttcattgtccatatcattatcagcattttggtcaaagccattcaattagtctctaggaagttccaaactttcccacatttttctgtcttcttctgagccttccaaactgttccatcctttgcctgctaaccagttccaaagtcgcttccacatttttgggtatctttacagcagcaccccactctaccagtaacaatttactgtattagtctgttctcacaattctaataaagacatacctgacactgggtagtttataaaggaaagaggtttaattgactcacagttccatatggctgaggaggcctcacaatcatagtggaaggcaagaaggagcaaagccacatcttacatggacggcagtagtcaagagagcttgtgtaggggaactcccccttataaaaccatcagatctcatgagacttatttactcccatgagaacagcacaggaaagacctgcctccatgattcaattacctcccaccagttgcctcccataacacatgggaattgtgaatgctacaattcaagatgagatttgtgtgggacacagccaaaccatattacccagcaatcgcattactagatgtatatccaaaggaatataaattattccattctaaagatacacgcatgtgtatgttcattgtggcactattcatgatagcaaagacatggaatcaacccaaatgcccatcagtgatagactgaattaagaaaatgtggtacatatacaacatggaatgctatgcagccatgaaaaggaaagagatcatgtccattatagggacacggatggagctggaagccaatatcctcagcaaaccagcacaggaagagaaaaccaaacaccgcatgttctcacttataattgggagctgaacaatgagaacacatggacacagggaggggaacaagtcacactggggcctgtcagggttggggacagagggagggagagcatcaggataaatatttaatgcatactgggtttactacctaggtgatgagttgataggtgctgcaaaccttcatgggacatcatggcacatgtttacctatgtagcaaatctgcacatcctgcacatgtatcctggaacttaaaataaaaataaatgtatagatatagatataggatgttaaccccttatcagatgtacattttacaaatatatgcttcccaatccacaggttgtctcttcacttgtcgctatttcctttgctgtgcagctttttagtctaatgtaatcccatttgtctatcttgacacataaaattaagcatcacattttgcacaggattgggagctattgaagggttttgagcagtgaaatgacataatctgctttacatgttaactatatcactgtggcatgagtactaaggcagaggcagaaaaaccagcaagtacctatttcaatattgcaggcaaaagataatggtgatttcagcaaggtaatagcaataagagtgatgagaaatgatcagattctacttgtttatttgacaatatcaactgactaagttttctgattatgtggatacgactgtgggagaaaaattccagtaaagtggactctaacattttgtcctgagcaacttaaaggatcaagctgcccccagctgagataggaaagatgttgagtaaagctgatttgggcaaagtttaggaattcagtcttggatggattgtgttaaaatgctatccaagtggcaatgtagagcaggcagttgcatatacttgtctgaaacttaaagggagtggtctattctttactcaaattcatacgataattcaagggatccaactcaaaactttcaacatttactgtatttccattgctcttctctacaccagcaccttgcttgtgctctttcttgccatgacccaacccctttttattctctgcacacccatcctctctcttctccatgtcttcatcgtggagaccaactgaacctctcaccttgtcactcttccccacctgtgaccccccgggtctgcccttctttgccctttgccagatctgcacccctgggcccactggctgagtgagagcaaccagtggattactaggagaggggaggagaagagaattggggcaggaaattatgcattctcttgggattctatgaggctgggtgaaacctatagattttgttatggtaaataatagccataataataatgtatatatgtatgtatgccaattgggggggctaaaattcatatttcaatgcctacttaagagaatcctagaattttagaattttaacaactctgaaagtttaaagatcatcttgtcccaccctatcactcaaatatgaaaaaagaaaacaagatcaatagcagtgaactaatttgtctgagcttcacttttttccagtaatttcaggattctctgctaatcaacatatcaatgtcatgcggtatatagagatatatctaatcagactaatttgtggaacatctacgatatgtagcactataaaaagtgctttatattcactatttcactgaatcctcaactctatgaggtagccaaaattggtctacttttatgaatgagtatccagggggctcagagagattaagtgagtggccctgggtcacacagctaggcaatgactgagccaggattaaaaattatctaagtctgatgcccttccctgtacatggctacctctctctaatgaaaaattatgtgtgttgaagtgagggtcagggttcaggaatatccacattaggtggtaattcattctctgaatctgttttggtctgctgaggacatgcttggctatcccagagattgaactggcatacttcataagcactgactttctctgaatgacctggctttgtcttcattcataggctggttatttcatttcctttgtgcaagaatttgtgtgttctatagtccctagtgggagcagttgtggaagtaagacggataaaatacccatcctatctcaaaacaagagagaaaaattcacacgtggggaaagagcatgcaaactctactagccaaaactattacaacagaaaaatcaattacaaacagaaatttgacatgaacaagtgtcaggaacttgtgacaaccatacaaagcagtcattgtgtcccagtgtaagataaactaactatgcttaatcaagagaagacacaaacgacagatctgcttctcttaccagttactgtgttatattttccaggcatataatttatttaaactgaattctaaaatatccttctacagaggattgggaaaggagttttaccttcataccaaggataatttgctagaaggaaaatagggattggtaatggagctacccagggacacagacttttatttttaatttagcagatgctagattcatgtgttcagtcattgctccttctgtcttgtgcgctgtactcaaaaaaaccttccctcctattggcaaatatacttccttcttcaaggcaagcagaaaagcaaggaaaatgcatgcaaataaaaaaaagaatctttgaatccgttagcctggtgttttcattttggttgaaacattgtgtggcattcattggttgtgccctcacctttgctacattttcacttagaaactttggataaagaataggcagtaattgtcaacatggcatatttcaacttctacgtgataatagagtgagatttctcaaccttggcactattgacattttccacgggataattcttcgttgtgggggctgttctgtgtattgcaagatgtttagcagcatccctggcctctacccactagatgccaggagcaccctcccccagtcacaacaatcaacaatatttccagggaaagagctgattctgtggctggggaaggaatatgcaaaatgagcctagtgcttcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccctagtgcttcttgtggtgttggaaagaaaggaagttatcaaaacacgcacacacacacacatacacacacacacacacacacacacacacacacacacacacacactggtaggcctatgtcaaaggcatacaggagccaactgaaagcattcccagtggccaaacctgaaataatttgagcaataaaattagtaaggtaggattggattataatccaaagtataaaataaatattcaagaggatataaataaatgagtaattaattaaatagggacaatagacaaatctcctgtgcagacaaattccaaataatgtatgtagatattcagccttcaaggagatggtgtggaattctctactctttaagggtgggctgtgcatagtgacttctatccaaagagtacagtatggaaagaaatcaaaaaaggaactttgccacggagaaacttgacaaacacgatctcagccacatgatcaaggtcaacatcaacagtgataggtcatattcgacaatatgtacccatgaaatgatgggatgagaatggcactttatctctgtggtcttttttccaagaccatagccatagtctaatcatgagaaaagcatcagacaaatccaaatcaagggacgttctccaaaatatttgactagtactcctcaaaactgccaaggtcatcaaaaaaaagaaaaagaaaaggaaaggccgggtgtggtggctcacacctgtaatcccagcactttgggaagccaaggcaggcgaatcccttgaggtcaggagttcgagaccagcctgaccaacatggtgaaatcccgtctctacaaaatacaaaaattagccaggcactttggcacatgcctataatcccagctacttgggaggctgagacatgagaatcacttgaacccaggaggcagaggttgcagtgagccaagatcctgtcactgcaccccagcctgggcaacagagctagactctgtctcaaaaacaaaaaacaaaaacaaacaaggaaattctgagaaactgtcatggctaagaggaacctatggagacagatgaacattgtgtatgtcctgcatgggatcctagaaaacagacatcaggtaaaagctaaagaaatttgaataaagaagaaaatgtatttaagaatagtgtatgagtattggttcattgttacaaacgtaccatactaattcttcctatgggagatgttaataatagggcaaacatagtgtgagatatatgggaactgtctgtaatatcttcacaacttctctgtaaatctaaaactgttctacaataaaaagataatttaaaaattgtctccagataccacaagtgtcccctgggaagcaaaagtatccccagttgagaacgactgctgtagaatatctgggttcaagtctcacttctaccactttttttcctgtgtggccttagacaaattctgtaatatctctaagcctctggaaaatggagagaataacaacgcctaccacagagaattggtgtgaggattcagcgacgtaatgtaaagtgcagactggcacttaaaaagcacttgataaatgtcagccatgataactctatccacggtaattattagtattaattcacttcgtatgaatgatgcgctgctgacacattctcagttgttcctatcctgtcaggccccagaaaaaaaaatatatatttcccaggcactttgagtttaaacaaatgtctcttcttaccttgaagaacagaatgtgcctttcagaaaatgacagactctcccggaacctgtggcctttccgggaaaagcccaaacaatgatcgacggtggcatttactgcactgagatgagacagccaagccggcctacatcacatttactctggttaggctcattgattgaatcccattggtgaggaaggcagtgcaatggcagaagtggaagatgaagccatctgtctgggtaggaaacaagggtcagggaagtgacaagagtgggctttgttccatgaggagtcagccgctgatgctggatcatttgtagtgaatcacgcctgggaaaagtttccaaactaccctttgtctgttcgatattggggctttttagtcatttaaccccctactttacagcagccaggcctcacagctgactagttataaagacctctgcttttagggagttagggctaaaggaaaatgcaaaatgccaccatacaattatataatatatatactttttttttcaactgagagataacattgtaaatttttggaggttttcttttgttttgtttgagacatgagaacaccaaccagggaccaaatggataccttatcccagggattccccaactcccgggccatggacagtagtggttcacaaaccttactgtgaactgtgcatgtgagggatctaggctgtgcactccttatgagaatctaactaatgcctgatgacctgaggtggaacagtttcatcctgaaaccaccatcacatcccctcccttcaccttccatggaaaaaattgtcttgcacaaagccagtccctattcccaaaaaggttggggactgctgtatccccttggaactgaagtcaggagaaaagtagaatctgttctatcatacccctgcattcagttactgaagactaatttgaagggccaagtgttgagaacaattcagtccaagcaatctttgtgggaggggttgctggaaagcagctgaactccaagagagcgtttgggtagaatgtagaccccaaaccccaagacagacagacttataaggcttcaggggatcagctatgtgctgctgtattaatctctggcttcttagacgacctttccccttggaccttgacctctgaagtcctgacttgatctcactttccttggcttcattcattcattcaagaaataattattaagtgcctactatgtgtctaggcagtagggatgcagtggtgaaacaagccagctggccttctaaaggtaggaaacaaagaaagaaagaaagaaacaaatgaataaacaagatagcctcaataatgagcactataatcaattagagtcagggaacagaaagtaactagatttaagataaactctacacaaaggggagatggtgaggtaagcatctctgaggagatggccttggagatgataaaggtagagacggagccaaacatgcaagaatctgtagaaagtatcatccaagcagtgacaaaagccagtgcaaagttcctgaattggggattttcttgatggcttcttgctgttgacttttgtatgccttatccagatcattttctttctatttagggaagtattttagactctaactgcatggaccattcattcatcagtttatgcattcatgcactcatttattaagcacctacttcctcccaggcactaggaataaaatagtgaagtagtaggtacttaatacaggtgtaagtcccaacctcttggaatttagagagtacagagatgatccttaaagcattccagtgcttgatgcaccaaatggcattatctcagaaggaggtcttggaccccctaccttgggcagcttatccatttagagaggatggaatcccaaagcctgattgcagatagatgctgggaaacagctggaaattcagtggcagaacttggcttcaagtccttattctgctactgacaagctgtgggacttcgccaaagtcacttagcctctctgagcctcagacttttcatctctaaaatgccttatgttatgacacttggctgtaaaatctagcccagagcccagaacatttcaggctctccataaatgtttaaggtgacatttgccccatttttgctggttttttgagttgttttcctgagagaccaaagctatgcgaactgtattaggaagaaatagaggtttttagttaacctagtttagtctgatttctacaaagagactatgtataccttaaaatccaaatgggatattttgcccaaagttacccattctattttctatattaatgcattcactctcaacaaagcttgaagttgagcccccttcccaagacctggattatccagttgcctctgtaataatgttaaataattgtgtagtatttacttgggtggggtataagaaactgctgccagtcttctcacaccttagatggggaatgcaatggactgtcaaagtaaaattcatgcaaatatcctagaaatgccatttcttaccgtttggcagtaaccagctcatccaggaaaatggaattgatcagtgttgaattatgtcatactcgctatggtctataaaatatggaaaccagaaactactgtgtaatgttaccccacagcattaaaccacttctcagagcagttaagctctaattatgaaaggaaacagatgttgccagttctcatctctcacaattcccacatctgtcaaggccctcctccatgggttagagtggggagatcctcaggggagaattggccattgggtttctcaatcacctcctggaattaggatcagtagtagaaacagagaggtgttttatgaaggtcaatttctagttacctcatgcaccagcccttaaatgacagcagggagcaacacttctgatttgtaccaaggcccctggagttactcagctgtattaaactattaggaggaagaatgaaaatcgaaatagatcgcatccatttgaggtgggctgctcaaaatgcgttcactgggagtgttaaattcaatatagatgacaaggtcggatgagatccactgcctcatcccaagcagcttaacgttcagctgctcaccacaggatattactgcacacttcattagattatacttctaacctgaaacaataactgttaaattccaaactacatcttagtcttggagatcgttcctcagaggtaccttaaccttgggacgggtagctgaatgggaatcgatttgtcatcttctaaaacttgctagagctaagagttcacaaattgacactcacacaacatattctgaattcgacagtggtttaaacttagctacagacttgtacagttctgtgcctggccaaaattgctgcagccctttaaaatattactttggaatcacatgcacaaatacgatactgctctcactgtggaaggttgtttacattaaaattgtggctgccttgtgaccctgtggccaaatttgtcatcggctaactttggccaaaattcatatttacctgcaccattttgaggtcacgaagtttaacctgaccagtgagaatatgaccacaaattctcaacccgttcgattctgtttcaccttcatctttctgctgctttgttcgtacaggctggggggttatgttccatgatcaatcttgtgctttcctaaagtgacaatatcttacctagacattattttttatctccctacacttcaaggtatcatctgtcttacagacaaatgaaatgttttcatgatgacaagtagcactcagtctttgcttcaaaggatgaatttgttcattcatttagtaagtatcagttgagtgtctactgtgtgtcaggtattgttttagggactgggctactgtgataatcctgaggggatctttagaactcacctgctactggagctcagacacaagaaacaagtaaacaaaaacacctaatttcagagagtgaatacagcaatgaaggaagtaaggaaattgtagggcatacaattagacaaggtaaccattgaatatcttttcaagaggtggcacttgtacagagatctgaaaagacttgggggaagaatattccagacagatggaacagcaaatgtaagcctctgaagcaggaataaacgtggttggttagaaaaacagagagtccagcataaaaagatgagaactaaggagtagacagggcaagattctgtgggacatgcttggtcggtccaggtcaggagttggggttttattttctgagtgacgggaaattatcacaaggctttagtagaagaaggatatgacctggtttaactttcttaaaggttatattttggctaatctgtagtgaatagatctataacattttgtctaaaatataatcactttagagaattgagttatggggattagatagttctcagtctaaatcccagctctaccatttagtagctcaccctgtgcaagttatttaatttctagctttataacttacagtggccaaatgggcatgaaaatacctgcctccttaaatcaggtcatatacacgtgagacacatagtaaatccacaatatatggtaaggttatttattcattcactcattttttttttacatgtttgtctattcaacagatgtgtatttaaccactggtattctgccccttcaaagtacagcacgcagcagtttttttgtcttctttcgttagctgcatattattcttcattattttggagcatttgatttgttatcatcactcccccaatatggctccattgtctggagaaacacccagggtccttggtctcaccccaagaaaattagcaacacggacacaagtggagtggtttaaggagcggaaagtttaataggaaagaaagaagaaaacagctcccccatacagagggaagagggctccgaatggaaaaccccacatgcagcagaaatcagtaggttctattgggaggctagaagacatggtgtctgatttgcatagggcccagaggattggtttgaccaggcatgtcattcatgtagcctgagagcaaactggccctcccaccctagccttttaacatgcctggctggccgccatgttgtcctgcacagttggcctctacctggctggtggccatgatgtcttccactagtggcaacaaagagaaagtggtaggaacctccacattgggtgggccgggcttttaacctccacattgggtggagcgggcatgtcaatgcttgcggatctggtttttcaagccgctttctgttagaaaagaaatgttttcatgggtgctttttattaaaagaaaaagctttagagaggactattttacccgctctatccgtctaatttttttattaactcctgtaatgcccccaaaacattttattctatttatttatttattttgagacagagtcttactctgttgcccaggctggagtgcaatggctcaatctcggctcactgcaacctccacctcccaggttcaagggatcctcctacctctgcctcccaagtagctgggagtacaggcatccatgcccggctaatttttgtatttttagtagagacgaggtttcaccatattggccaggctggtcttgaactcctgacctcaggtgatccgcccacatgggcctccccaagtgctggggttaggggtgtgagccactgtgccctgaccccgcaactttttaatatgaggatgttcccagtttgctatttctcagatatttttgtgcttccttgaatccctaaaccctcctgagaacctgaaatgagcacataaatcctagattctcattcatttggtaaatactgaccttctctccccacagcatgtgaaggataaggttttatgatgctaaattagttgttctcaatatctaaaataccagaaatgatgaccatacattaaagcaatgaagtgattgaaaccaataaagaagcctaataattacagtacaattctattacaagaggataacgcttcacagtgtctaccaaaataatcatagttttaaacactgttgattgtccttcaaccaaatgcagacctttttagaagagtttacttccctgactaagctctctaatactcataaggcaaagttcttaaatattccacaaaacatacgcttttttccttgatgataacttgatatcatgattagcctcttctccctgtcagcacgttttctctgttctgcagggtttcatgagcctcactcagcacaacctgatgcctgacagaaatcatcataataatatgtaccctcagttgtaacaaaaaaaattgtacacatcaatcaatacattcgaaggatacatggcacaccagtaaaattgagacatcccttttgagaaccactaaagtaaggagtgtcaccagacacctgatatttatttcaaacagcaataattgctcctggaatagtaccacatagactgtgatattgttactgcacaaaatccccagcctagtatttggtcaaaattttgcaaagttttgcaaagacactcttgatatttcctgagaactgtctatgtcctaagtaattgtgtccagagaggtttgtgacttacacaaagttctcccaaaatgagacttcttgcaaatataaactaatgaacaccttctagagctctaatggcagctcagagcctgacaaaataaagtatgaagtttaataaagtcctatgaacgtgcttccagatgccactctgttcttccagtgaaattcctgacagcatgttcggcaaattttccctgaagtgaccatgaggccagcatgtaaaatagcaatgcaatgcggaaatgggaagctgctgatatctagcagccaggctgaacggagaccctgtattttgatatccattttgatctattcttggaaaatgtcacttgaaagtaccattcacatactccttcttcagtcgtcttgaggagactgatatggcatgttcaggggcatcctcctttctccatctattggttaaactttctaagagttgttctaatatttgtagcaaaaaaaaagcatttgctgagaaattacagccagtgattcacctgaattctcttattttttctcaacgattctgtgaagtaaataccattattttttaattttaaaaatgtttcatttgttcaataataaattaaacttaacttcttgtaacttttttcctttattgattttttatttttttaagtttttgactcttttgtaataacatttagcttaatacacaaaaaatgcatagttgtacgaaaatgtctttatatttttatgtttttagtttttttaaatttttaaaattaatttttttattacaatagctttttgggaaacaggtggtgtttggttacatgaataagtgctttttttttttttttttttttaagacagtcttgctctgtcacccaggctggagtgcagtggcacaatctcagctcactgcaacctctgcctcctgggttcaagcaactctcatgcctcagcctcccaagtagcaggaactacaggagtgcaccaccatgcctggctaattttttgtatttttagtagggacagggtttcaccatgttgctaggctggtcttgaactcctgaccccaagtgatctgcctgccttgacctcccaaagtgctgggattacaggtgtgagccaccatgcctggccacatgaataagttctttagtggtgatttgtgagattttggtgcagccatcacccaagcagtatatgctgtacccaatctgtagtcttttatccctcacctgccccacccttagtcccctgagtccccagagtccattgtatcattcttatgcctttacgtcctcatagcttagctcacacttatgagtgagaacacatgatgtttggttttccattccagagttacttcacttagtataatggtctccaattccatccaggttgctgtgaatgccattatttcatttctttttgtggctgagtaatattccatggtgcgtgtgtgtgtgtgtatatatatatttatatatatatgtatatatgtatgtatatatgtacatacatataaaagtatatattttctttatccatttgttgattaatgggcatttgggctagttccatatttttgcagttgtgaattgtgctgctataaacatgcatgtgcaagtacctttttcgtataatgacttactttcctctggctagataccctgtagtgagactgctggatcaaatagatggcagttctatttttagttctttaaggaatccccacactgctttccatagtggttgtactagtttacattcctacccgcagtgtaaaagtgttcccttttcacagtatccacaccaacatctattattttttgatttttttattatggccattctttcaggagtaaggtggtatcacattgtggctttgatttgcatttcgctgatcattaatgatgttgagcatttttttcatatgtttcttggctatttgtatatcttcttttgagaattgtctattcatggccttagaccacttttttttgggattgtttgttttttttcttgctgatttgtttgagttccttgtagattctgtatattagtcctttgtcagatatatagattgcaaagattttctcctactaagtaggttgtctgtttacgcagctgattatttctgttgctgtgcagaagcttttttctttaattaagtgccatctgtttatctttgttttctttgcatttccttttgggttcttggtcatgaagtctttgtctaggtctatgtctagaaggatttttctgattttatcttctagaatttttatgctttcaggcattagatttaagtccttaatccatcttgaggtgttttttgtataaggttacagatgaggatccagtttcattttcctacatgtggcttgccaattatcccagcaccatttgttgaataggatattctttccttactttatgtttttgtttgctttgtcaaagatcagttgactttatttctgtgttctttattctgttccattggtctatgtgcctatttttatgccagtgccatgctgttatggtgaccatgagtttatagtacagtttgaagtcaagtaatgtgatgcctccagaatttgttcttttcgcttagtcttgctttggctatgtgggctcttttctggttccatatgaattttaagattgtattttctagttctgtgaagaatgatgttggcactttgatgggaattgcactgaatttgtagattgcttttgtcaatatggtcattttcacaatattgatcctagccatccataagcatggaatacgcttccatttgtgtcatctatgatttctttcagcagtgttttgtagttttccttgtagaggtctttcaccttcttggttaggtatatttctcagttttttgtttgtttgtttgttttttgctttttttattttgcagctattgtaaaaggggttgatttcttaatttgattctcagcttggccgctattggtgtacagcagagctactgatttgtgtagattaattttgtattctgaaattttgctgaattcattcatcagttctaggagctttttggaggagcctttagagttttctaggaatacagtcatatcatcagcaaacagcaacagtttgacttcttctataccagtttggatgccctttatttttttctcttgtctgattgctctggctaggatttccagtactatgttctatagaagtggtaagaatggacattcttgtcttgtcccagttcttagggggaatgctttcaacttttccccattcagtattatattggctgtgagtttgtcatagatggcttttattacattaagttatgtcccttttatgctgattttgctgagggttttaaaaggactagattttgtcaaatgctttttctgcatctattgagatgattatgtgatttttatttttaattctgtttatgtggtctatcacatttattgacttgtgtatgttaagccatcggtgcatccctggtataaaatccacttgatcgtggtgggttatctttttgatatgctgttgaattcaatttgctagtattttgttgaggatatttgcatctatattcatcagggatattggtctgtagttttctttttttattatgttctttcctggtttggggattagggtgatactgacttcatagaataattttgggaggattttctcttttctatcttggggaatagtgtcaatagtattgctaccaattcttctttgtatgtctgatagaattcagctgtgaatccatctgatcctggattttttttggtgggggggggttggcaattttttttattaccatttcaatcttgctgcaccttatttgtctgttcaaagtttctatttcttcctggtttaatctaagatgggtgtatatttccaggaatttatccatctcctctaggttttctagtttgtacatgcaaaggtgttcatactagacttgaatgatcttttgtatttctgtggtatcagttgtaatattgcctgttttgtttctaattgagcttatttggatcttctctcttctttttttggttaatcttgctaatggtcgatcagttttatttaccttttcaaagaaaaagatttttgtttcatttactctttgtactttttttgttttaatttcatttaattctgctctgatatttgttatttctttcttctgctgggtttgggtgtggtttgtttttgtttctctagttccttgaggtttgaccttagattgtctgtttgtgctctttcagactttttgatataggcatttaaggctatgaactttccttttaacaccacctttcctgtatcgcagaggttttgataggttttgtcactgttattgttctgttgaaagaatttttaaattcccagtaatcattcaggagcatgttatttaatttccatgtatttgcatggttttgagggttccttctggagttgattccaaattttattccactgttgtctgagagagtacttgatataatttcagttttcttaaatgtattgagacttgttttgtggcctatcatatggcctatcttggagaaagttccatgtgctgatgaatagagtgtatattcttcatttgttgggtagaatgttctgtaaatatctgttaagtccatttgttctagggtacagtttaaatccattgtttctctgttgagtttttgtctttatgacctgtctagtgttgtcagtggaatactgaagtttcacactaatattgtgttgacatctatcccatttcttaagtctaatagtaactgttttataaatctggaagctccgatgttaggtgtatatatatttaggattgtgatatttttcctcttggactagtctttttatcattatataatgtccatctttgtcttttttaactgatgttgctttaaagtttgttttgtcttatataagaatagctacttctgcctgctttttggtgtccattcgcatggaatatctttttccactctttaagtttatgtgagtccttatgtgttaggtgattcttttgaagacagcagatacttagttggtgaacttttatccattctgccattctgtgtcttttaagtggaacatttcgtttatttacattcaatgttagtattgagatgtgaggtactattctattcatcatgctatttgttgcctgaaaaccttgaggatttttttattgcgtttttgttttataggtcctgtgagatttacgctttaaacaggttctattttcgtgtgtttcaaggattttttcaagatttagagctccttttagcagttcttgtagtgctggcatggtactggcgaattctctcagcatttgtttatctgaaaaagactatctttcgttgatttatgaagcttagtttcactggatacaaaattcttggctgataattgttttgtttaaggaggctgaagataggaccccaatgctttctagcttgtagggtttctgctgagaaatctgctgttaatctgataggttttcctttataggttacctggtgcttttgcctcatagctcttaagattctttcctttgttttgactttagataacttgacgactatgtgcctaggcaatgacctttttgtgataaatttctgaggtgttctttgagcttcttttatttggatgtctagatttctggcaaggccgaggacattttccttgattattccctcaaatatgtttttcagtaaataccattattaaaccagatttatcaatatggaaactgaggcatagagaggtgaagcaacttatctcaagttatcagtgttctttttggagctaggaattcagtcacagaaatgaagaagtgttaagtttttcacattctgatggttaacctttattctgcatttgcctatgtgtcgtgtgttggctctagagaaatcaactatggccaccagagcccagatctggcaacaaaagtaaaacttaatagaaaaacatcaagtcactgccttgggaaaggatgcttatttagctgcctggaaaagaacttaactggctaaacagagttttgtccttttgtcctctaaaactctcccatggtgtatctggatgtcctcactgggatagcataaactattgatcccaatttctttagctctctgcagtggagttatatgtccacacctcttctgtggccttctggtagttgtgatgtattttccagcccttgactgtgtgtttggacatacaacctgttttaacagtgggctgttagtgaacatgatatgagcatacagttgaattgtgctttcagggttgggcttgccctctttcatgaaaagggcatgctgaaggtagcttctgccctttcagcttgagcaatagaatgttctgagcccaaccaaaaggctagagccaagcccagctgacccacaggtagaagcagagctgctcagcagctaagtcactgacccaagtgcatgataacaaacggttgttatttgaagccactaagcttaggggtaatttgttacatggcattattgtggctattgctaaccagtacactgtgacaaacacaaactagaggttctttttcagtttctgtgtaaactctttggttgtatctcagtcctctcctcctgaacttgctgggtcacctaacatagtatcaacagttcctctacttgccagcaaagtttcaagtcctggactgtttagctcaatgattcttagtgcagacccttcatttggttggaagagaaaagacaggtgtcagagtcagtgtgtaaagtagaagttatgactgatcaaaaacacccttgaagagcttgcaaattatccccgaagttcagagtcatgattttgtgtttatagctctgcaaatgtatgcttatcccagtttaagaaaccccaaagaaagaaacaaaaacagggtctctgtgcagatacctggactttcaaactcttctgcttttaacataattagaaaattcctagcagtgagtcagaaatatgtgaaaactctaaacattctctatgtgctcagagtttgtaccatttttccattaagacatctaaccttaacctgtttgaggatttgatagagtaggatctgattgcagagaacaggtctggaaaaagcttaggtctaaattcagtttgtagattaaatgtgttcatggccaccttcaccataattaattttttaaaactttttttcaatagttgtagggatacaagtggtttttggttaaattttagactaaaattttcgtgtacccaccacttgactagagtacattgtacccaatatgtagttttattatcctccactcctctcccaccctcccatcctctgaatctccaaagtccattatatcactctatatgcctttgcatacgcatagcttagccccccacttataattgagaacatatggtatttagttgtccattcttgagttacttcacttagaagaatggcctctagctccatccaagttgctgcaaaagacattattttattctttgttatggctgaggagtattccatggtatgtgtgtatatatgtatacattatagatatgtattatatatgtgtgtattatatataattatatataatgtgtgtattatatataattatatataatgtgtgtattatatataattatatataatgtgtgtattatatataattatatataatgtgtgtattatatataattatatataatgtgtgtattatatataattatatataatgtatattgtatagaattatatataatgtgtgtattatatagaattatatataatgtgtgtattatatataattatatatataatgtgtgtattgtatataattatatataatgtgtgtattatatataattatatataatgtgtgtattatatataattatatataatgtgtgtattatatataattatatataatgtgtgtattatatataattatatatataatgtgtgtattatatataattatatataatgtgtgtattatatataattatatataatgtgtgtattatatataattatatataatgtgtgtattatatataattatatatataatgtgtgtattatatgtaattatatatataatgtgtgtattatatgtaattatatatataatatgtgtattatatgtaattatatatataatatgtgtattatatatacataatattgtctttatccactcaccaactgatggacacttaggttggttttgtatctttgtaatgaccaccataattcctactttacctgctaaacccagaacaacttcaaataataagcaaaataattctcctttatatttcctatactcccacattgtcctcagtgtttcatctcagatactaagctgtgggctaggaaggtagacacatgaaaaatatatcgtgagagacttaaactttgcctcagcctacagaataaccatactgagaaattatatcctctagtctgtggaagaacaactaaaataaataaattaattaaaaaacaacctgtccctagcaagtatctgtgggagggaaattaggtcccatgtgatcttatgccatcactgtatgatgctttcaccttctgtggcagatgcacagtacaattaaatttctcttaaagctatatttattccatttaaaaacctgaatttttactgaggttatgttctttctacttttttggtgttcaaactattttttaaaactagaagacaaatgaaggcaggtgtgtgtgtgagtgtgtgcttggtgtgcaagtgtgatggattttttatgacctattgtgacatgtagaaagttggatgtccaaattctatcttggtcatttactagttcatgaaactcaaacaccatgagagatttcatgagagatttcattcacttagacagttaaagggccagcagcaaattggttagccagtggaactcaaaatctttccactgggaacccctgtccccagaatggaggggtaaattttccaaaagaaatgataatttctcacatttacaaccctgtcatctactttaaactttttcacaagctaggagaaaggcagggtataagttattagaattttatagttgatggattaagtctcagagtgattaagtcccacctcagtgccagaattagaatttgaaaccaggccttctacttcagtttcaaatctctttctactagagtgttataatatctactttggcaaactgctaaggctgaccttctttgttgaccaagaagattgcttaaatatacaagtttctcctgccctaaaagtcactctgtagtctgagatgcaactaattaaaattcccctgttaggctttttagaatactatctctgccttctagaattctgctttttgaagcatagaccaaaagccaccacctccatgaagccttttctgagtccgtctcttccacccagacagatataatttatttgtgctctgaatgccccattgggcttggtgtttcctcttggggcaagtaggtgctgggtctctacgcacctactactagattgcaaacatcccacgatgttttctacttttagcaccattcctctttccttttgccaacacatcacaattcagattcgttttagctttaaacaggaaaaaaaatcaaagctccctcactctcttagcaaaacatggtcattccgtttgccctgagcaagttccatctaccctcacataagtcctggaaatcagggaggacagaaaaataaggccaccatgaaagagttattgagatccttcttgacaccctagcttgatgaaatgaaaagactgtagactgagatgtacctgggtttgaatcccactccctcgtcattctagttaaataaatttggccaaatcactgaccttctcttcacctccatttcctcatctgtgcaagagtcaatgtatatgatggaacttttatgcctgacacattggaggcactcaattaaatggtagcaccttattgttactggtattgctgctacttttgctgatattcttactaacattcttactggctcatactccccctgaggaaacattagctcttgtccacaatgccctttgtactcatagccgtctttgtctcctatccttttcagatcactccatggggccaccagcaggtttcctcatgcaatatataaatagcgaatattggaaccagagtattaatttagcctagacttttttccagccttcccactggcctgccttgtagatggatgaactggagcagaaataaggaggcaatgttctttcttcatatcacacacctaagggatttttttttagtcttctgagaacattaaattctacctcgagctcaaagtaactctcaatgagagaaatcattcatgggaaacaggggaaggcgctgaacttcaaagccaaactgaatcgcagctggtaccccctgcaactctcaagaataggaaagcagcagtcggagaaactagaatggagtgctgtggggtgggggcgaggatgaacaaccactctggcatttaaataacattggcagcttaaactcaagccatcatttcaagaaaattccaacataaggtgaagtagtttaaagtgtaaaaagttgactcttctgcagaggcaactttttatactttacttgtcattctcatatgaaacctgcaagtccatgttaagaaactgttgcctggaaatcggaagtgttaaagatgatcgataaagttaccttacagggaaggctgagccaaagccggctttttaattttattttatttctcctatttatcttgtaggtgcattaagaatagattgcttgctcataaatgtaactgattatttggctggttatgtagctgttgctattttgaactcctgagtttctggctttctggtgggaagtttaatagctcattaaatggtataccgtctcatttttatccagcctcactttctgctgttttaatacgtgctgaggaatttggagatgtaccctcatttgaacaaatgatgctggataaagagccatgctcagccccgaacacagtaaagttttttaataatgtaaatttgagttcatagtgagtattgaaacagagctatatagtttccaaacttacgtcagatctcgtttaatcttcacgaggtagaaaagtattcattcattacaaaatacttcctacaaagtgccaggcattgtgttcaatgttgtgtctgcaattctagatagcatcatttctctatttttaaatgaggaacctggtttcagcaagattaagtgacttggccaaggtcacaggagtgagcaaaagacccagttcctctgattcaaatcccatgttcatttccacagaataaacatatagctgaaaggagctttagagatcatatcaatgtttatatatgagaaaaataagcattcggtcctaagtttacacatgtgtactgtgtatacacatgtacacatagtgaaatggggatgggaactcaagtcccacaacacttagtgtattgtcttacacaaaaggatactttaagattaacttattctatatttttaggtcatctctgaagtctactttcttctctgaagtacatgctccaaaatttcttctccaagtacatcccctcaggacaccttagaatataagagaaacattctgaccaaatttgtctccatcttgacctcaggcactttagtctgtgttgaaacttctttttctttttttaagagaagtctttatttacttgttttgaaaaaaaaaaaagctggctaagttggttgctttttggtgatcaatgagaccaaactccatatccttgtccaactctcgattcctccttggttcaaccttggctgtagctgtggccacagtaggagcagcagtgatagcagaggtcacacgggcagcagccacaaggcaggtagatcagccaagaaggtcttgaccttttcagcaagtgggaaggtgcaatcagtctccacagacaaagccaggacttctttgtacccgttgatgataaaatggggtactgatgcaacagctgggtaaccaatctgcaaacactggcaccatgcagacaccctggaagagaggatgcagagtgtcccctgtgatgtaaagcacttcagggatgtagatgctgccattgtcagacactggcttgatgatccgccaaggaataggggagacgttcagccgtatggcttcactggctcccactttgtctccagtcttaatgagctgcacatcccttacgatttcaacgatgcccctggagattttggtggtgatgcctaatgcctggaagaacacctggtctcagcatggttttctgggcacagagacttcacatggggcagtggcaccagcattggtggtagctggcaccttattggccagcagtgtgtccctgaactcagaacataatgaacatgacccaactgacggctccaactggtccatcaactaagaattttgcctctctcctgtctgcaggcatagtcaacttctaaaaatgtaaattgtgttggtggtttcccactgcatttagaagaaaatgctgagtctggtcctgcagggtgcttcaatgtgagcttctttgcctgcttgtccagcctcatcttgttcctctctctctctccctcatgaccatttggccatgctggtctgcttttagttctggaatgtctcaagttgtttcctgccttagcacatgccgtgctttcctttgtactggtcttcccatctctttacttagcaaactcctccttatccttcagagtctcaggagaaatgtcccttcctcagaaaggctctctctaattccattctcaaccaggtctctctttttgcttccttatagcccatctacctttcatgatacttacatacatttgtcatcccatatttatttgtgtaattggctatttaatgagctccgatggaagaagggactatgtctattattttcaccactttgcctggcacatggtagtggcttagtaaatatttattggatgcatacattaatggcatctagtgaatcctttaaaatctagtcattaacatgtctgttctggcctgtgtttagatctccggaaagccaacacttgtcttatttatctttgctgttcccacaatacctcatgtggtccccaacacaaagcaaatgtttagtagtgtttatagaagagccatctcatgaaggaatacaattcaatattattgttgatcccaaggaacagatcgtcaacagaggctgtaagcatcctcaatccaactagaaaaattctctaccatcctgcccgcctgccttgttaaacaggctaatgtgcctttgcagctttgttgagttcccacttgtttaaagctgtgttggtgaagttattttaatgcaggtatcattagtttgaaaaagctcttagccccttcacagaagtcttgaaaaatatcagcagcctaactgatgatgccatccatggagactggatagcttaagacagttaaattaaacataaatcaaggaggaaaagggaataaaagtgaccttctggccaccagtaatcatccttctggccactagtttttatcctctggaggataactttgctactgcagttttaaatctagaaatataaatggattgttggtaggaagagtggtaatatcctgaaggaatttgtatcgtttttgtaccaggagatcctacctgctttcccaatcacccctctacaaaaagagcttgagggctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagataagactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcagtccctgaaagggatgaggctgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaacaaacaaaaaaaaaaaaaaaaaaaaaaagagcttgaggaagtagtgcatacaatggattgaagctgaatgaatcaaaataccaatggactgttaggtagatttgtgcctgctacactactagaggactgcactctctggcaagctgagctgaagtgtcctcccataggttggtctttgggtgtgggccatagactagcaacatctgtatcacctgagaacttgctaaaaatgcagaatctgtggcttccaaacctactgagtcagaatctctattttaacaaaaacccctcagtgattgtatgcacatttattttggaagcaagataaagaagagagaggagcagagcgagagctacagccaaccgttatgtctaatgaatcctatgcaccaccctttgccttctagtcagtatcctttagaaagagaccattatcatggcagaactttaaggtattttatcttcccatgtggtataccccaagtcatgagagtcaagcaaagtcccaggtcctggctgactcagagagaaagactttcacaagaatttcatgaactccaaaatgataactagtaacaaacttgctttcactaattgcagccaaaagctgtaaatactcacatccctaagacagaatggctggaggcagagaactgagaaagcttagcatttattatgtcaaaagatataagaataaactctttggtaacctataataaaaacaacaatataaattcctagacaagaaaaaagtttattttatctatacctatagccttgcttacagtggtctggaactgggtttctgggctgaagatatgaatgacagagaaaataaaacttagttatctgggaggaaaaggaaaacaagaaaattcaccatgccattgtctgactattacatggaatctggttttgaagacttaagatgaatattagggaaagaactgtagatttagagcctattttatttcattcattcaaagtctattttaacattgaacttaaagagtttcaatgctatacctcaatatcatatgtacaacctcttaatttgcagtgaccgcatacaatagtaaattttctataaagtattccaaaatctgaccaataaaattagtattccctttttcttgggaagagtaacagagtaataaagagagataacaatttctgtatgaaatgcagcctcatgcaggcaggcttaaaagggaaaatgaatctcaaagggcattgcagaggggcatgtgtgcatggaaaagaaaaattacatgtgaaactgaggccataggggagtgtctgttgacttcagacctctgagaaatttttcagagtcctcagaacagctttaactctgttccccaagcagaggagaaaataatgccttttaaatatattttcatagagtagcatcctttattattattattattttattattatttttttttgaggtggagtcttgttctgtcggcaggctggaatgaaatggcacaatatcggctcactgcaacctccgcctcccaggttcaagtgattctcctgcctcagcctcccgagtagctgggactacaggtgcgcaccaccatgcccagctaatttttgtatttttagtagagacggcacttcaccatgttggccaggatggtctcgatctcttgacctcgtgatccgcctgtctcagccttccgaagtgctgggattacaggcatgagccaccgcacccagcccctgtattatttttaatgtatttttttctcccactacagtgaggagctacccagtagagattcccaccaacacacacacacacacacacacacaaaggatccttccacgtagatacatgaatttccattgtcctagttagcatagtttcatcttctattaaggttttcaaggcagggtcttaaatcctgacttggagccttaaggagcagtaaaaacattaaacatggagttgtttttcctcaaaattcaactgtgaaatatttaaatcctgaaaaaaaaagggaaaaaaaagaacttttgtgaattttaatctcatggtattgctagcatatgggcaacttcagaaataagacaatgacttgtttcaaaagaaatctgatttttgatagacttaaatatcctctgcccacaccatcccagctgtctgctgggttgattggtcagtccatactggggtttatgggattaagattgttttaacaaaagctatgagtttttttatttaaaaaaatgtttttaagctatgcttatatagtgatcagacatatgtgtccttatatgattttaagaattaccctccaaagtatgcagacaaaatacaattgattttgtttacagatgaggaaattgaggctcagtggagttaagtgatgtgcccagagtagtatatctggaacgataatccaggcctcctgactcttacacctattattcagttttataatacaaaattgcctcatctgcttctaggaaaagagcatttctctgaattccatatcatgtattgatgtcccattgtcctgatgaatagcctctaactttgttctgtcaatactaatctccttcttttactataagcagttaaaagtagccatgcagcagcctgaatgttttcctgcctaaatatttcttccaccaaatattcttgttcctcattcttaaattctgccttccataaagccctagggcatggacacaatgcagctaagttctttacaacagaataacaaggatggcctttagtccagtttccaatgtcttgatcttcatttccatctaagaactcatcagaatggcctttactgtttatatttctgtcaacattctggtcacacaaattaagtaatctctaagaagtttcagacttttcctagtcaatcctcctgagtcctcaccagaatcactcttaacattctgtttatgaaaattcaggctttttctagcttgttcttccaaagtctttcaacctctaccagttacctagttctcaagctaattctacattttcaagtatctgctataccaacaaccacacttcttggtaccaattttctgtcttagtccttttctgttgctataacagaatacctgagactgggtaatttataatgaacagaaatttatttggctcatgattctggagactgggaaatccaaaagcatggcaccagcatctgtgagggccttcttgctgtgccataatgtggcatagggcatcacatggtgagaaagcaagtgagtgcaggtcagcttaagtgacttctttttataaagtcaacagtcctatcatgagggccctaccctaaagactttgtctcatcctaattacctcacaaaggctccacaaccaatcaacatatgagtgtggggattatgttttctttatttttattttttatttttttttgagacagaatttcactgatctcggctcactgcaacctctgcctcccaggttcaagcgattctccttcctcagcctcctgagtagctgggattacaggtgcctgccaccatgcccagctaattttttgtatatttagtggagttggggttttgccatgttgggcaggctggtcttgaactcctgacctcaggtgatctacctgccttggccctccacagtgctgggattacaggcgtgagccaccatgcctggccaggattatgttttctacacatgaaatttgaggaacacatttaaaccgtagtaccctcatttgaattatttcagaattttttagtttacagtatatttgagttctctttagccacccatttgattgaccagatttaaacattctttaatgcaaatattcatgaaagcttatttaagggacatatggatgtgtacatgaaacccatatctcaacccctcctctcccctcttatcatgaccccaagatagaacacactcaagatagacaaggctttcagtctggagttccttcccctagggagtggtttgacttatggataatgctatgttaatggcactttctgaaccattgacttggtaccctatattttccatccaagggaaagccaaaggtgtgtcattggttcttagggccctactctaatggctggttataaagccaaagatgcagccacaatctattccagggctcagaatttaaggtatctctccctacttctctccattggaaaagaactagcttttcataagtcccaacccaaatcattttatcagaatctgaagggtttattgctcactggattttttttccagtcagcagataatattaatgcatcaattctttcatcttaattaaggagacacatttaataaatcacaatgatcatctggttcttttctactgaccaatacaaagttgcagactgatatgtaatacagagctaagacacaattgctacctctatattgcacattagcactattttggtttattattccagctgtcaaagataatcacaaacaacttaaagaattacctcctacaaatcttccacctatctcaagactagcattcctttcaggtgaattttcttttttttaagttagagattttttttaaattatggttgactacagataaaagcaatatattatatttttagttttttttcctctccaacttttgaaagtctctgctttggggcagaaactatggggttttctaggtataaaatcatattgttcatgaagagaggtaatttgacttcctttcttcctattttgatgccttttatttctttctcttgcctgattgctctggctaggatttccagtactatgttgaataggagtggtgagaacaggcatccttgtcttgttacagttctcaaggagaatgcttctagcttttgcccattcggtatgctcttggcagtggatttataatagatgactcattattttgaagtagtttccttcgatgcctggtttgttgatgatttttaacaagaaaggatgttgaattttatcaaaaagcccttcctgtgtctattgagatgatcatatgattttgtttttagttctgtttatgtgatgaatcacatttattgatttacacatgctgagccaaccttgcatcccaggaataaaatctacttgattgtgtttgattagctttttgatgtgctgctggattcggtttgctagtgttttgttgaggatttttgcatccctgttcgtgagggatattgacctgaagttttctatttttgttatgtccctgccaggttttggtatcagaatgatgctggcctcatagagtagaatgagttggggtggagttcctctttctcaattcgctggattagttttaataggatttataccagctctttacacatctggtataattcagctgtgaatctgtcttgtccagggcttttcctggttcgtaggctttttattactgattcaatttcagaactcattattggtctcttcaggctttttaatttcttcctgtttcaatcttgggaggttgtatgtttccaggaatttacccatctcttgtaggttttctagtttgtctgcataaaggtgtttgtagtagtctctgagtattttttgtatttctgtgaggtcagtagaaatgtcccctttgtcatttctaattgtgtttatttggatcttctctcttttttctttattagtctagccagcagcctattagtcctcttccttcaaaaaacaaactcttggtttcattgatcattggtgtcatttttttgcttctcaatttcattcagtttagctttgattttgcttatttcttttcttctgctgtctttggggttggtttgctcttgtttttctagttcctctaggtgtgatattaggttgttaatttgagatctttctaatttttgatgtgaacatttaatgctataaactttcctcttaagattgctttacatgtgtctcagagattctggtatattatagcttagttctcattagtttcaaagaatttcttgatttccccccttaatttcattgtctacacaaaagtcattcaggagcaggctgtttaatttccatgtaattgtatggttttgagagatcatcttagtattaatttctgtttttattgtgctgtgctccaagaatgtgtttcttatgatttggagtattttttagtttgttgagaattgttttatgtgtgagtgtctggttgattttagagtgcatgccacatgagaagagaagaacatatattgtataggtgtcttttacacccatttggtcaagtgtcgagtttaagtcccaaatatatttgttagttttctgcttccatgatgtgtctaatactgtcattgcgatgttgaggtcccccactattattgtgtggttatctaagttacctcataggtatgtaagaacttgttttatgaatataggtgatccagtgtctgactgtattgtgaaattcttatagtgagttatttagctctatcagatcagtttggttgagctcttgtttcattttattggattccttagattccttggattgggtttcaactttctcctgaatctcaatgatctttgttactatccagatactgaattcaatgtctgtcttttcagccatttcagcctggttaagaaccattgctgaagagctagtgtgattgtttggaggtaagaagacactctgactttttgagttgccagagttcttgagctggttatttctcatctgtgtgggctgatgttcctttagtatttgacattgctgtccttcggatggggtttttttgcttttgtattcttcagtgcccttgagggtttgacccagttgactggctttgttcctggattatttcagggtgccaagactcagctcaccactcctaggctgtgtgctctaaccctggagggttggtaccaagcctacagctttactctctggcccctcgaggttaagcacctgctgtgttggaggggctgaggtgttcccactccactggtaaaaatgctctgatggggtgccggcaaaagcacttcatttgggtggtggcagcagggtccatgctcatgtgcatgtatgccggcagtagtggggtggtagagaccacatgcgtgtgctcactccagcagcattgatgtggtggtgtctgtgtgcatatgctggtggcaacagtggtgtgggagggtgtgtacacaccagcaaatgtggggtggtggcatccatatgcacacatgtactgtacacctgcactggcaggggcagggcagcagtggcgaggttcacgtgtgcactggcggcaatagcgtggtgaggtccacacatgctggcaaagcagtgggaggaggctgtgggcaagtgcacatcctctggggcccatctactgaagctctctgacagttaggcggggactaccagcaaagaatctatggtgatggctaccagaaagtgcttccaaggctgcgctgcaagcagatacagccaggcagggaccacaggagaggccaacaaacaggggcctgctcagatcagactggtcctgtcccacaggcaagaccaccctgctttgtctaggtccaagagtcaacaaaagccaaagccacctagaggagcatggcaagccttggggtatgacatccctggccatgctccactgtagccattcccacgccaaaccctctgggctccacacaggctagagttctgtccctgccacctctccaagcagctgtccctgtcagctcaaatgttcatgggggtcatagggtctcctgcagctaggattctgaagatccatggtgagagtaggccactccttgcctatttaactcactccttccccaggagccactgaaggccaggaataagtcctggtactcagcagtcctgtacagggttcctaccttactccccctgcagctcagggtttgcatcctccctccgtctattctcaatgccttccttccgaaggtctgctcagagcgtgccagtcttctctatctggtctttttgtgggagatgttcttcctgcctgcatatagttggccatcttgcctcttctccctgaaaatttataagagagtggattttaagtgctatggcctagaaataggaggcacggcatgccaagcaggccatgtaaggaaacctcaggaagcctcagtgtgatcagaagacagagtagcagaaacaagggcgctttcaggtaaattttaaagagacagttctggtactaagctgtagcaacagcattcattaccaaggtgcattttcttgttcatggaatcactcaatgcttggcacaaactgccattttttcactcatttaacaaatctttactgtgtgactactctgtgccaggcactattttaagatagatagatagaatatatatatatatatatatatatatatgtctattaaacctctttttctttataaatttatatatatatatatatatatatatatatatatatatatatatataaactcttcctttggaagagtttatagtctagctagagagagagataaatatatcaatattcattgttaaattggagtaggaataaatgactaaataaagcagtgattggaagcaggaagtgttggggagtgaggctgggaattgcaattttatatatgatggtcatgggaggcctaatggagaaggaaatggtgtgagcaaagaccgaaaagacatacagatatgtagggaaagagcaatccaggcagagaagttaggaagtgcagagttcctgaggctagagaatgcttggtgagttttacaaacaaggagaggacgatgaagtggctggggaggaatcggtgtgttgtagagcagtagtggacagacaaggtcagagtggagctcaggatcataccatgtaaagttctgacaggcatcaaaaagtctttgagtttgtgtctggatgagatgtgaactactaaaagatttgagtggaggaattacatggtctatcttaattttaagagaatcactcttgtgcccatgtgttcatgtaacaaacacttattgagcatatacttagcatcaagcttgacgccaggaattggggacacaaagttaaacaaaatttggcttcttctttcagttcacggaatctgctgcagctatttatacaggttgctctgaaaatgagttaaatgtcttatttaattcagtacatgggcaaggaccatgggttgtgagtgagtgaggctgtagttttattccactgctgagtgcctcaaccattcccatgtattgccttctgtttgattggtgccaagcccatttttcacaggctcatccattactttccctaatctgactaataatttctttcttatggctgaatcaaggctggtatatattcaagttaaaagtgttttgtattaaaatgtatttcatcagatttcaaaaagccaagttctctctgtaaggagaaatgcagattatccaaaggaatcttatgatcatttgcaactgtgggttgctttattgaggagcatgcaagtaaggaatgctaaaatcatttccacttcccctccacactctctccaagttggcaattaaatcactatatgtgaaccttgaggcagaatgaatgttctcaggccaatttgggggtaaattatctggtaaaagaaaccaaaaccagcctccctaataacttccataacacaaagtcactttttactgttactgtgtctgtgacataatttacaaaattcccttttgccaagaggggactaagtgggcatgctcttcatacccaggttattagtcggcttttgctatacagcaagctatcactaagtctcagcagcacacagtaatcagcaattatctctgttcaagttgggcagttgagctggtgtctctgcttcagggtgtgggttgtgctcaaatgtactgaggcccagactgaagaactggagcatgttcctctcactgtagacattagaagctcccagtatagtgagttgaaaggtgtccccacaccctacaaaatgttctaactccttgatatggtttggctgtgtccccacccaaatctcatctggaattttagctcccacaattcccaagtgtggtgggagggacccggtgggaggtaattgaatcgtaggggtgggtctttcctatgcttttcttgtgatagtgaataagtctcatgaaatctgatggttttataaagaggagtttccctgcacatgctctatcttccctgccactgtgtaagatgtgacttgctcctccttgccttccaccatgattgtgaggcctccccagacatgtggaactatgagtcaattaaacctcttttctttgtaaattacccagccttgggtatgtctttatcagtagggtgaatatggactaatacaccttttgaacctgtaaatgtgatcttatttaggaaaaaaagtcttctataggttgaatgtttgtttcccccaaaattcatatgtttaagcccttaccctcaatatgatagtatttggaggcagggcctttgggaggtaattaggtttagatgagagtggaacttccatgatggtattggtgccgttttaagaagagggagagacatcagcgctctctctctctctctctcttcaactatgtgaggctatggcaagaagatggccatctgcaaaccaggaagagggtcttcgcaagacatggcatctgccagcaccttgatcttgaacttttcagcctccagaagtgtgaaaaataaatatctgttgtttaagtcaccaagtctatggtatttcatcatagcagcccaagctaactaagacagtgtctttgtaaatgtaattaagtccaggatcttaagatgagataatcatttgcaatctatgtgggtactatatccaatgaccaagtaagggttctcataagatacagaagagaagatggtacaaggaggctgtggaaagataaagacagagattagaattaggcaagcacaagcctaggaacacactttgcagggagaacagctttgttgacctcttgactttgaacttctggcctccagaacagtgaaagaatttcagttattttataccatcaagtttgcagtaatttgttacagcaaccacagaaaaccaatacacagagggatgaatggaaacatatgaagatcatacaacataagcttggaatccagacactgtcccttctacctaccttccattagccaaaacctgtcaccaggacaagcccagtacccatgaagctgggatgtacactactcctatggaggtcagggaggagtgaaagcaagagattttttgctgaataataatctaccatactttgttttgtttctttcgtagcatttgctcactaggtcttccttccaaatctaggattccagaagacaactcagaacttacctggggatttctgtacatagaaaccagtgttctaagataaaaggatgatggatgaatcataggaagttcagtggatatgagccaagttcccaaagaggaaatggtaaggatttctaagcctcaactagcctcccgtctctgcacagatctccaacactttagatacaaaagatacaccatgcaaatacacctctcctaaagcactggccctgaatgctatgctctttgatcctggtgagctgagctgaaagttgctgagaggactgctttctaacctctttccttttgactcattttttttagaatgggccttggaccacctgtatggaattacttagggtgtgatatggtttggctgtgtctccacccaaatctcatcttgttttgtagctcccataattcccacatgttgtttgagggacctgatgggagataattgaatcatggaggtagtttctctcctactgttctcatggcagtgaataagtctcatgagatctgatggttttataaggggaaatccctttcacttggttcttattctctcttgacttctgccatataagatatgcctcggccgggtgcagtggctcacgtctgtaatgtcagcactttgggaggccaaggtgggcggatcacgaggtcaggagatcgagaccatcctggctaacacagtgaaatcccgtctctactaaaaatacaaaaaaaaattagccgggcatggtggcgggcacctgtagtcccagctactcagggggctgaggcaggagaatggcatcaacccaggaggcagagcttgcagtgagcagagatcgtgccactacacttcagcctgtgcaacagagcgagactccatcccccaaaaaaaaagatgtgcctcttgccttctgccatgattgtgaggcctccccaggcacgtgaaactgtgagtctattaaacctctttttctttataaattacacagtctcaagcatgtctttattagtatcatgaaagtggactaatacagggtgcttcttacaaatgcaagtttttcaatctactgctcaccccctgaatcagaatctctggcaattttaacacacatctcagagaattttgatgcacactaatttaaacatcactgttgtttctcaaactttatactatcttgtatatatcaccagcacccattagcagatgtgagtgatcctgtactttctgggaatatgggttcaccatcctaagtctctgtgataggaaatttcctttaactctagtgttttctctctcaagttcatgaatattaaccttctattctacaatgtgtttgctccattgaagacaaatattttcccctagacttttggttaaattgaggctcaacagtttttttttaatttattattattatactttaagttttagggtacatgtgcacaatgtgcaggttagttacatatgtatacatgtgccatgctggtgtgctgcacccattaactcgtcatttagcattaagtatagctcctaatgctatccctcccccctcccccctcccccctccccccaccacacaacagtccccagagtgtgatgttccccttcctgtgtccatgtgttctgattgttcaatttccacctatgagtgagaacatgcggtgtttggttttttgtcctggcaatagtttactgagaatgatgatttccaatttcatccatgtccctacaaaggacatgaactcatcattttttatggctgcatagtattccatggtgtatatgtgccacattttcttaatccagtctatcattgttggacatttgggttggtttcaagtctttgctattgtgaatagtgccgcaataaacatacgtgtgcatgtgtctttatagtagcatgatttatagtcttttgggtatatacccagtaatgggatggctatataaacagaaccaaagacaaaaaccacatgattatctcaatagatgcagaaaaggcctttgacaaaattcaacaaccttcatgctaaaaactctcaatgaattcggtattgatgggacatatctcaaaataataagagctatctatgacaaacccacggccaatatcatactgaatgggcaaaaacaggaagcattccctttgaaaactggcacaagacagggatgccctctctcaccactcctattcaacatagtgttgggaggcttaacagttttgctgagccagcagctttgtgcattgctcaccatgccattcttcacagccttctatgtcttcaccctgatgctggatcactctggtgttgaggaggggacacatggggaggagttcttcagagtctcttttccagagaaatctagatatgctcacgcaaaaagtacttggtatttacttttgagggcctcacaacccctgtgaagcattttgagggctcctaggtgaggaggccttagtctaaagtttacagcagtgtagctagatgattcatttctataatgaaaacaataataaagtgataactagcatttactgagcacttaccacatgccaggcactggtctaaacttcttacctgctttatctcatttcacccttgtactgccctgaggagtaggtatcgttattaactccattttatagttgggaaacacaggcctttgagaggccatatagctagacccagttcaataacctctttctcgcaggccacatgctgatttttctcatacctcctagagttccccttgctgaagactaaagtaaaattacctggcctattgtcaaaccatacagatcaccttaacttttcccctgaaagaaggggactccggagaaataatcagtagccttgaatactctttggcttgacccatgggcatctcgtggccatgtcttacatgttcattgcttatctgttcattttcctgcacactatttactatttacctgttcgttattttaacacaaaattgagtctccagtgtccaatgtggtgaccaccagtatacaatacattcatggtgataagagcaatgaggaaaattaggcaagtttaggaaaaagagagtgttgaggttggcagtaacatttgaaataagataggtgcaatggtttggatatttgactctccaaacctcatgttgaaatttgatccccaatataggaagaggggcttaatgggaggtattttggtcatggggtgaagccctcatgaagagatgaatatcctccttggcagggtcgggaggggatgagtgagttctcactctgttagttcctgcaacagctggttgttaatgtttttcccgtttgccccgagaatacttgcaggtggtgcttgcggctgccgcatttaccccaaaataactttgccacaaaatatttcacatttgttattatgttcacatcactttagtaaatagactttggaaacaaaacacatcattctatttatagcattctgtttttagtagtggtatttccatttacaaaatacagtaattctcaatggctgaaaatgtcaaatcctagaaaacatagcatgccaatgatgttaacatcattcttgaacagttgttggctgaagattcattgcatgaatccaatgtttctgaaatagacaattctgatcattcagatgattgtgatattagttattatacataactacaagaacagtttctatattttattttcacattgaaaatcagtcagatttacttcagccacaaagagtgtgtttatgtaaaattaaatgagtgctggcagtgagctgcacattttatttttctaaacaggaaaagggttaaaaagagcctggagcctccctgcttgctctcttacctcctctctcaccctgtgatctctgcacatgctggctcccctttctctgaaactcccaccaggagctgatgctagtgccatgcttcttgtacagcctgcagaaccatgactcaaataaacctcttttctttgtaaattacccagccttaggtattcctttacagcaacactaaatggactaagacaatagagaaggtccttttgataaattgacacttgagcagagacctgaaggaagtcaggagagagccatgaggataatcaggagcaaggttttcagccagagggaagagtaagtgcaaggcaagagcaaagagttcagcttggaggtcccacatgaagtgattagtaagggggagatatagcagatgagatctgagaacatggggaagctggggacaggttgcataggtccttatggcaaggactctagatttcattagaaaccatcggaggacaaaagcaggagagagacatgttaaaactcatctttgtcaagaattactgagccagactgatgagcactttacatatcaaaatgtatgacaagcccacacgaatattaaccagaaacacaagtccagcccaaatggccaaacattccaagtacttttttattttgagtgcttgcttgtatccagaagcatgttaggtgctgggagatcaggtatgtaacaaaaattcccagcaccaggcagggtcagcccgagagactgggagactgggcaagttaggtggcagaagtgctttgaccctctgttagagggcaccaggcctggctggcaaatcttcaagcactcagcaccacagtatgtgtgtgtgtgtgtgtgtgtgtgtgtgtgtggatatatatatatatatatccactctcacatcacctccttcatttatttgctcccatttcacccacacacagtcatatgtctcagctatttgtttcctgaccctgaggccttttacagtaaaggccttccacctgtttaactcaggtgccctctaaatggagcaacaatcagcccttgctgtcttgagctgttcccaccagggcctcctccccaaaggactgacctcaggtacaatgtatacagaaaacaaactgcaatccttccttttacccaaggccctgcctgcagggaagcattttttctccttgctgtgacagtgaattggagatttgtggacactcctgtgctgcatggtaaggatgcctgctgcctaaacaattacctggaattcagcaatgagttccctttatacccagtggtcattagggctatggctactgctttaagactctgagatttttttttgcataaagattggttgcactgccaggttttttttaaagtctctatttttcatagtgctctgtagccatgtaagcaggaagagagaaaatttatcttgagcatatgatattcacttaataagtaagaagaatggagcagaaccccactagagcacagctaggattctgaaaggagtcagacatgtctcctggaataattcctatcccgaattatatcccgaatttgctgtgttcaggcaaaagccagctctggccacagcactggctgtaacaaggcatctcatcatgttataaaattgggagaatatgttgtttctctctccagtatctatttaatcccacccaaaatcaggtttctgatttctctttgcggaattcatccctcagcccttctcagccatgtattttaacctcacatctttatttccagagtttctgattggcttaagccattcctccccaggccttgggtcacagaagagcacctgagcaatcagaaccaataagatactgtaaacagcctagcggaaaagctgtgttcccaggaaaagagggaccctttctttctcaacccctaaaacatgtggtgtggggaaatggaatatagtgctgctagtgaaatactgcagccattctagaggacaaggcaaatgcagagcccaaagctgaagaaaactctacagatgccagaacaaagagatggagggcaatttggacataggtaacatagatacctttgaagcaagcctcacctgacatatcctattctctgggccagtggtttcccatgtgaggaccagcagagtcagctttacctgagaactcatcggaaatgcaaattttttggtccccactctagacttcctgaaacagaactctgtgcatggggtctgtagggtaaacgcccttgacagtaataacttaagcatacccttagaatgacactgtatgtcagatgcacctaaatgtgtgttccaagctagggaatccaccagtggccaacctggagatttgttccttgtctatgaggaagatctgagcctccagcctgtcccatggaacatggaccatacaggggatagaggctctgagtttggggggggcgggggggtggggggggagggtaaatgaaggtaaccaggtggaggttgttagtgggagggagttaagtgaaaatcctgtataaactgcatgatatttgtaggtggttgtgattttcctgctgagcccttcgccactgggctgtgaggtcatgtgatccagcctgccaccgctggactatttttgtaattaaggcagttctcctgtccagcccactgtcactggactctcttcctggtatggaaacccctaataaggtctcatttgctggctctgagtctcttctttagcctcttgaacctcgtgcttccctactgaggttaatagggggttggcacaacaggactcagcaatctgcattgtaacaagccctccgggtgattatggttacactaaagtttgagaaccgctgttgttaactatacagtaagttgacagaaaatcagctgttttaagtatcactattctagagtttttagtaccatgtatccatttctttcttagtaaaaccagtctgaacttggtttgtgtgtttctcttaccagcttcaatctttttgttctaacacttgatagaaaattagatgagttatcttaattataatccttccctacatcacactggcttatctgatgaggagatctgttccttaggacatctttatgaaggacacaaactgagcaaggatatttggtatacaaactcctcattgtggagatgagaaaaccaagtgccttcctgtaggtctcctgactggctaaaatacttctggtctggttctttctcccattcttggcagcccatgaggctgagtgattagatcagcaggtgaaagaggtgggcaaacctgggtttaaaccctgactctgctacactctagctgtaagacacagggcatgtcatttcaagcttgtgtgcctcagtttcctcatttgtaaaatggtgaaacagcactacttactttaggtggctgctgtaagaattcacaccattccagtgaaaatgtgtatggaaagaatgaagggcttagtaaatgctcaataaattgtatagtaagaatattgtcaaattcatcacatcattgtctctgccctactgcctgtaaaatgcagtctacgcaaagcagactgcattgagcatgttatttaggagaagcagtatctcagttatgcactgaatccagcctgcttatttccaaggacgctctgaattaccttcgcctcacacctgaactagagcatcttatagggtcagcattataaggtaatctcacacttcagcttcctatgagaagctgtgtttctcacccacaacctccccgttaaggcctcctttcttcttaagggggtgatactgctgttgctaaattgttttaatcaccatcagaacaatgaaaaggtttagtaattcttaataaagaacagctcttctagaatcagtggctgtctcactcatttccaaccatgcttaatttttgactgttcccacttagccatttaataaaaaaatttgacttcctaccttttctcaggcatccaggtgggtggtatgctaccttggaaggagaaccaccatacaaagtctggcaatatttttgcagtctcaattatctggccttgctctagataatgtcactggtctttcagcatggccatgacttgagtgacacaccagtggcacttttgtgatagaagttaaatggagtagaattgtggcaggccaggtctcactcatgcagggctctataacaactgtttcagtactgactgagtggttaagttaaatattgaaagccagtgcccttatacaaaggctggaatgtaacaaaagcccaccaagagttttgcctaggcctttcctgggccttaaagcacgacaaaataacgaaggaattcttaacaggacccatttaggagtaaacaagttttattgtgggtctgaagaaactccccaggcctccacaaacaagtttattgggggtctgaaggaactccccaaacctctatgatttagcaggagacaagataaggataattaccccagcacctggacctatttagagtaagcaaacttactgaggctccagaggaaaaggtcttcaggactcagaccttagttatagattaaaagaagttaatcacttacgtctttagataaatgcacacttacatgtagatgtatagcttagaaggtatataagctctggacaacttcataattttgagttggtctggtgataatttccaggccttctccctgtaaccggttacagaaataaaaactctcttcctcctccgttcatcagcatctcattactgggccacaagaaatagcagcccaaccctcagtttggtccaggaacagaatcttatagccaaatgatataaaatggctcttgggttcaaaccccagctttgccacttaatacctgtgtgatttgtgcaagatatttagcccttaagctctttcccagcccatgagggaggtgaaagggccgtaaaggataaatgtgcaacctgtctgaaaattaatacttatgcttgggagcagcacatctggtaacctgggcactgggagaggtgatgattatgatcatcactcatcagccacccactcatcacccacccactcatcagtcacccatccacccactgcgcctgtataaaagcccttatatttttttttctggtccttcagtgctttagtttatccatttataaaataaagtaatggaatcaacacatagaattattataattattaaatgagttaatgtttataaaacccttaaatatgaatcataatgaataatatttgccatttactaagaacttactttgtgccagactttatgctaagcactttacatataacagctaaatttattccaaccataaatcagtgaagtacagtagtatgagaataaataatattgctaatattaatgatggcaataataatatatgcaacaggcagtatactaagtattctgtcaaatctcacaacatctttattagggaggttctattataatccccattttgcagatgaataaactgaggcacaacaagttaagtctcctgagaaagcaagtaagtgacagagctgggattcatactcagtcatctccgataccatgtcccaacctctcaattgcccaccaactcaaaatcacataaaagaatgatgtcagtgttcaaattttctagaatcataggatagatcaaaaacattgatatcatttcttcctctcagaaaaatgattccaaatgggagctatatgaatggagagttttgttttttttgttgttgttgttttttgttttttattcttttcagagagggaatcctgctctgtcacccaggctggagtgcagtagcgtgatctcagctcactgcaagctccgcctcccgggttcacaccattctcctgcctcagcctcccgagtagctgggactacaggcacccaccaccacacccagctaatttttgtatttttagtagacacagggtttcactgtgttagccaggatggtctcgatttcctgacctcgtgatccgcctgcctcagtctcccaaagtgcagggattacaggtgtgagccaccacgcccagcctgtatggagagttttaaaagctcacaattggctgtctggccagccctatgtgctctatgaaaatgagggattctttccaaagtgaaaagctgtaatagtaataggttttaaaaactatagagtcagcatcttgcagaagatactcaactgggtaatttttttaaaaaatggaggcttttataacatccaattatatgacaagtgagttacatttaaaggcattgaaaaaattattccaaatacgaactgaacagtgttatcaactttaattagtcctcatattaagctctttccaagcccatgacggaggcgaaggagctataaatgataagcatgcatcccatctgaaacggtacttccaactcggagcagcatgtttggtaaccaggtcactggaggagggtgatgatcatgactgccactcatcagccaatcccccccatgacgattttatgtatatcatgcattactgctagccaccatgaatattacatagtactataattgcttgagcgtccatggtacataccaagccaaaccttacattaatcctctacccctgagaatccaaaattctccgtgccacctgtcgcaccctatcctaaagtaaggtcagctaaataagctatcgggtggatgtgggtacagtgttagattgagataatatcatttatgggggaggggcactttgtgaagtgggccccatttctcttgtcctttcgtactgggagaaatgtagaacagatagaaactgacctggactgctccagtctgaactcagatcacgtaccgcccatccgctgcacctgtataaagcccttacgtttttttctggttcttggtaaagtgatttagttggactcttattaatctcattttacaaatgaggaaactgaaccaaggagatagcaagcaatttgcccagggttcctatttcttgggaagggggctaaactggggttcatactgaggtctgtgtactggaaagccaatgtgcttttcattatgtcatgatgacactctaaaaacacaagtgaaaaaatacagctcagttatgaagaaataacttttattttctttctacaatgtcacctataggtagggatgtaagttttttagaggtgggaacaaattgaagtcttgctattatggaaatacgtataaaaaggtagagtatggcaaatccctcctaggtactaagtcgaagtgtttgcatatttatctttatatggtagtgttttatgccaacctggtacaaagtacatgctccgtagatgttcactcaattggcttgaatttttttcttctagttcccaaatcacttaggtggagccaaatgcattttaagttcattgaaccctggtagagtgtctggtagtttctggtatccactttaccctccaaaacacaatggtaaccatgtaggtgctcaaataatgcaataaacacatctctcacagagaatctgttatagtgaccttcaagttcagcatcagcattttgggggactatgaagaacaaagctggatgttgacaaggatctagaccacaatggtagctgtattcctagaaattttgactgagcaggattgagggaatacagattacagattcatattcttaaagcaagaccccattgagttctaatccatatacagaaagaaaaaataatgaaagcccaccaaaatagctcaactctccggtcttcttggaatcttgagattattataattattgtattcacctttacatggaattagcttagaaacttgaccaagtggccaggagcttttttaagagaactatctttctttgagattggggatgttattttattttgattttccagagctgatttttatttttctttggtcacagagttctagtaatataaaggagtttggggagaaagtatctcagaaaacagggataggctataaattcttctagcagggaaagggcactctggtagggaaaataatggttccccaaagatgttcatgttctaacccctgaaacctgtaaatatgttatccttagatggcaaaggagattttgcaagtgtgattctgttaagcacatcctgaattatttgagtgggcccaatgtcatcacaaggatccttgtaagagagaggtagtcatgttctagagcagcagtcctcaacctttttggcaccagggaccagtttcatggaaggcaatttttccatgggcctgggtaggaggatggtttggggatgattcaaacacattacctgtattgtgtactttatttctattgttattaaactataatatataatgaaatagttatagaactcaccataatatagaatgaatgggagccctgagcttgttttcctgcaactacagggtcccatctaggggtgacgggagacagcgacaaatcatcaggcattagattctcataaggagcacaaaacctagatccatcacatacacagttcacaatagggttcacgctcctctgagaatctaatgccaccactgatatgacaggaggcagagttcaggtggcaatgcaagcaacggggagtgactgtaaatagaaatgatgcttcactccctcacccacccctcatctcctgctatgtggcctggttcctaacaaaccatgaaccagtaccagtccatggcctggggattggggactcctgttctagagagtcggagaaggagatgtgatggaaacagaggtgagtgatgaaatggctcctctgaaaaaatggaagagatctacaagccaagaaatgcaggcaactagattcctcagctttctagaagctgagaatggtgggtaacagatgttcccctagagttcagagaagggatgtagtgacacttctcacctctggaaatgtaagataataaatttgtattgtttaagccatctagtttgcagtcatttgtcatagtagcaataggaagctaacacaaggactaagttcctgagcagcagcttccgccaaagagagaaatatttcttatatgagtctaagaaaatattctacctgcttagaagtctgagtattacctttggctacttgtgatttactttaaggtctttcagcctcagcactattaacattttgggtcagatcattctttatcgtggggctgttctgtgcattgtaggatattcagcagcacttctggcctctgcccactagatgccaggagcacctcccccacccccaacagctgtgataaccaaaattgtctccagatattgccaaatgtgccctatttgaaggaagggcagcaaaactgctcccaggatgagaactattgctccagtatgatcatatcctccttgattataaaatttctgatgacagtgagcaagccatctttctcccacgatcctaattcataaattagccaaaccctgagacacacaaaatatgctttagtcagtgtcattttgctgctcaattatgaggcaaaaaatccttgcctcaagactagatggaataatctcatggcttataccaagagatcagacaggatttatttctggatgaaactcagctgataacccaaggcaagttattaatctgctcagcccagccagctagcacctcatgcctgttactctgagtagataccaaataaaacattatatcaaattgagtgggatagcttcctgccccccttccttatttggataatttaactggggatcctattcataattattactgcatcaaaaattgcaagatgttttagaatgaaatgcagtgaagcatgggtagaagggaaggatgagttctgtgccttccctggttccaagatatgggtgttattgggcataggcgcaaaagcagcctctataagccaagtttttccttctctgagttaatgtgccagctaaaggatgcctactttcaaaagaatgagaaagagagagagattccagctcactttccaaaacaaactcttattttggcatgaataggtttggcaaagagagacattgcaggcaggaaggcaggcagaactggggaaaggataagagaataaatgaccatgagttaagattatctaggatggaaggctaggatgatgttatggactgaatgtttgtatgccccaaaattcatatcttgctaccctaacccccagtgtgttatttgaaggtgggacctttgggaggtaattaaatttaaatgagatcatgagggcaggtcctccatgatgggattagtgttcttgtaagagaaggaacagaccagacagagcgcactcactctctgccattcaaagacatagtaagaaggtggctatctgcaaaccaggaagagagccctcacccagaccccaaccatgctggtaccttgaccttggacttcccagtctccagaactgtgagacataaatgtgtgtggcttaaagccaccctgtctatggtatgctcttatagcaacacaaactaacagatgagcaaccaaaccacagaaattatatcaaaaggtagaaagatactaacacatttgagcatcagggagtgacctccctcatcagcaccacaaacacaagacctctatataaaatcagttttttgagttatataaacatgaaaataatgtgataggttgaagacaggagctagattcttactagctatgtgaccatagacaggtttctttgttgttttattttttgtttgtttccatattaaaatggcaataataatacctgccttgaaataatataagaaaagaatcaatcatacatatatgacatatatgaaagtactaggtgtaaagggaagtcagttcccctcctattcccaagtcccctcccatctaacctcaccctggtcagtttaaaataagtcaaatctgaacgttccaggtttaactagtccgtgagcgtaaatgaagacatgtgaacatttatgccccatctagataaatcaccagcccttacgtactcaagtatgaagactagtccttgcaggtgtctccttgtggtaaatatctacaaacactggttttgtaaaccccccttccagccctcattcttctagtaagagcatcttggttctcctttgagaaatcacctcttttctatgcagtgggggccattgataccccatctcatacatacatacacacctgactccaggagagaatacttccttgggtctggccaatgaatttcttaaccaatacccgccccagaccgaagtgaatccatctcagaaatctcagcaatagttagaactactggggagggagaagctcactttctgctgggatttgtggttgcacatgtagtataatcccagagctctcagagaccaccaggatgagaaggcctgtatgaaactaaaagtcactgcagaagaaagcagaggtaagagatggagagagacagtacaacaattcccctggattcagctattcctgaagctagtaggtcccttgacttcttagggatgtgagtcataaatccctttatgtttaagccagaataattaggtgtctcttactccctacagacagactcctaataaacataccctcccttaagtctttctgaaaattgccttggggtgaaattacctgtgtgtatgaattagatttcccagccagagattctgtagctgctgtcaaatgccatctgaaccatcccaggactaatttgcttggtaggtgtacagaaggccacgctgccaccgtcatttgcatacacctaggagtctgatcacagccattgtcttggagctaactataaagttgtttcactgtcagccaaacaagaaacaatgcctcagtcctcctgaaactattagaactaagccataccttcataatagacagggataatccttccccatttcttgtgatactgagtgaggaattcagggagaatctaattttatccagctgcaaaagttccagctgttaacttgctgcttgaagtcccccaaacatgaaacattcagagctaactcactctctcccttttaccctagccattttctcttccaaaaggctcagccagcacttttactaaaatagcactggaccagttttttctaatcagagaagtaaaagagaaacagtaggcaggaaaagaaagcaagggaggttgaagtataagtgtagggtccgaatgatctgttgtcatgatttgtggcaacacagcatttagaaaggaatgtcactaatgagaggtttcattttattcacaaattttttcctgatgtggaaaactgtgactttcttttgctagttaactgcaaaataaactttggaaaacatattcataggaataatgaatcacttggatactaacctaatccatggcatcgagatcagtgcagatatttaggaattagtaatatatttggatacatgattgacacaccaatcttgcctttttgtatatctacttttctgtgaggagatcttctcacagagccattttggcagtatgtcttacttgggtatatcttttgttaatttctctacatttcaattaaaaaatattccatgagtgtgtaaccattatttgaaaatgtctgcaatgaagaaggaaataatttaaagatgggtaagaccaagatgcctgtaatattgtaaaacatatttagtctttgtccccatttcctggcatacaactcgtacaatttttggagtcttcaaactgatgtgttttttttgtatgctaatattttgactgatgggttgcagtcccctaggtagctttaggatgggagctggtcaccaaaagaccaaggcaagattagggggaagggaacggggcccaaaggttaagttgatcactaacgggcaatggtttaatcaatcatgcctatgtaatgaagtctccttgaaagcccaaaaggactaggttcagagagcttctggatggcttaacacatggaggctgcttgagggtggtaagctcaggggggacctgaaagctcagcacctcctccctcatatgcactcctcatctgtatcctttgcaataccctttataataaaccagtaagtttaactgtttcccggaattctgtgagctgctctaggaaattaagcccgaggaaagaaccttgatttataggcagttggtcagaagcacaggttaaataacctggagcttgtgattggcatcagaagtgcagggcagtcttggggactaagtcctcaacttgtgatattctgacactgtctacctggagatagtgtcagaattgaattgaattagagaacacccagctagtgtctcctgcaaaattgcttccttgcttgcttggtgtgtagggaaaaaaaaagcccccacatctggtcacagaagtcttctgtgttgattgttgagataatgggaaaagcactttggtttcgtttttattccaatattctcaatgccttaataattttctgcttaaataattccagcaacattattactctgtcactgttaaacctgtaggagctcagagagtttggaatgctacttttgaaataaaaacataaagtggattagataatgagctatattctttcttaacaccacctagttttgaaattaataacctgttaaggagtctgccatgtgtctagaaacaatagacttcaccggatcctttttttctaaatcacttgctgtttttcccaaggcttcctccaaaggattcaaagctatctcttccttcctccaagctaaataaaaatgtaggaccgggacagtcctgtcctatcagcctatgtctcttgaaatgtacatgtcccaagttcaagaaaaaacaaccaatggcaaccataaaccaactagaatgtctctgtgccccattttcaaatcccaagagaatgtgatggccagtgttgagccaggggtccacctctggtccaattagctcagccagagcagtgacactatggatgagaaacattgtcattaatagccacagggttattttggaggtaactcagattcacagatggcagcttaaaagaaaagcgtatttgtgattccaaattcaaaccaaagcccaccccctaccttctttctcttctatgctccattgctatcattagctaattatagccacagagcctacccctctgaatccttgcctggagaaagcttgtttctctttaaatggagctcagccaacagttgcttgttctcatgtaaatttcatacaaacaggccctgaaacttaaaaggatatctttaaaccccattaaataacacagttccttagcaggaatttctcttgggaagggatgtcttctattcaaatgctatgttatgacaagcatgacagacttgatggggatctgttctgactcatgacattgcataaattgggttaggtggaatgtgtgcctgcattctaagaaaagctcctcggggcctcagccctattatttttgttaatagctctgaattatgactatctcctcctaggaatgatacaccccatttccacattgggtgcgtcatggaatctatgtaatacatgattccttaccggcaaagccaagtggcctgcacacattaaaaactaatttacagttgtacttcttcctctccttctcttcttcccctaggccagagttggcctgcctcaccaccagaacttcagtttctcccaaatgtgatgaggtccctgctgtttctaatttaacttttaccaaagggaggaactctagaatggattctgatccacactgtattcctcaaactcgattcacaggcaacatttctttaggggcaaaggtttaacttgtgcatgttttcatcattattggttattatcagaagtaaaaaattggctctttgagaccattttgtgcatactacaaattcttagctataaggcaaatccagctccttgtgttatattcaaggaaatctgaaacaggacatagtttgttggaagttttacaatccactcaaacagacttaaggaaataagaatttgttgacttttatgaatgaaaattccagctcctccctcccatctgcccccatgcaaagttagacctaaagatttgaacatcactgggacagagtttctctccaccacttagttctgttttccttagtgttggcttcactctcaggcagcttcctgtagccagtaaagatgcctggcagctacaggatcacattttccaaacattaagccaggagaaaggaagatcttcttctccagtaaatccaataaaatcccataatttctacaggcttagtttcagtcactggggtgaaaagaccaaggcactctgattggccaaacctagctcataggtctgtcattagagccggaaagtgagatcaacctacctgaactacagtgcgcgatgcaagagataaggtcttctccaaaggaaaagcaagatgctgtcataaaaataaagggcagcatgaacagcaaagcccatttgcaatatgtgttggtctgcttaagctgccataacaaaatactacagactggtggcttaagcgacggaaatttactttcccacagtttgaggcaagaagatcaaggtgacagggggcttggtttctagggaggtctctgttcctggtttgcagatggctcccttctcattgtgtcctcatatggcctctttcctgtgtgcacacactcttgaggtctcttcctctttcttataaggaaaacagtcctatcagctaggaccccacccttatgacctcatttaactttaattacctccttcaaggccccatcttcaaatacagtcctattacaggttatggcttcaacttatgcaccttaggggacaaaattaagttcataaatagaatgaataagtgatataacaattaaggtcataaaattaaatagaataaataagtgatataatccagataataattaaaagcagggctgaggctggaagtcgcatcataactcctaaaacaatgttctctttgccttattaccttttgatctccctctgtaaatctttgacaagcttcttgtttggagctagggatcagaagctgtccaggacagaaaatgagcctagtccaaagttctcaacttcaccactattggcatttagggccagacaaatctttattcttgggagatgtgccatgcattgtaggttgtttggcagcatcctacccaccagatgccggcagcacaccctttccacccccactctccccaagtgtgaacaatcaaaaatgtctccagacattgccaaatgtcacctggggagtaaaatagccctagtttcaaaaccattggcctagttatttgagcgtcttatctattattgttttactacaaaatagcctttcagtattctgtcgctcggattgctactacaaggaatccttgtgcataagaataaattagattctcagggcccaattccagagactataattaagtagtcatatgtgaagccaaaaaatatgcatttttgtaagtcttttgaaaccaagcttcaaaaagtactactggtcattttatcactagttccttcattcaagacgtgatttactgagtgtgtactatgccaagagtagtcctcaaagctggtacacaaaatcacatctttcaaagagctttcatactggaggagaagacagacaagaaacataataaataagtaacaaataagtgacaaagctaattggaagaagggattgccaagagcaggaataaagtaaatttgtaaatagagtagacggagttaacctcaatgatggagtcacatatgagcagatacatggaggatttgaggaagtgtgccatgcatgttaactgggggaagagcatgtcagagagaaaatagcccatgaaaaggccctgaggtggatgtccgcctaacttattcaaggagtagcaagaagatgacatgactgagtgaggtagagtgagcaagaggaagaggaagatgagttgagagctgagaggtaatgagggccacatcatgcaaaatattatctaaaattatcaggacttcatacaatgaggagccaggaaagagttttgagcagaggcacgacatgatttaactgatgtctggttgctgtatttagaatactcaatgggaggaaatgagaaaaaagagaccagttaggtgattattagaattggcaacaaggaattcgttggtgacattgctggaagtagtttcagtggagtctggaggaacacctgaaaaaacttgttgaataagttcggggagaatgtggagaccattagcatagatcattcttagaggaggtttgtaaaagcagagcagataaaggaagctttagctggagggagcaatggaatcaaggaagattgtttaaaggtggcagagagtgcaacgtgttctacacagctgggaacaatctagtagaggagccagaattgatgaagtaggggaaagaaagcagggaattaactgcaggagcagtgtttttgagcagagaggttgggcttttgtacgtaagggaaagtgttgcctttggggagaaatgtggctggttcccctatggtgacaagaaggaagacacagcatatagacacacctgctgaaaggtaagtggttgtggagatgggagtttgtggaagttctcttgttattgctttaattgtctctgaaggaaacagcaaagtcatcaaagaatgatgagcagaaggagatgttagcattttgagaagggaggaggtgtcaggaagcatgtgggagactgaaccgatgtgttaataatgccaagcagcacggctgaacaccagaaggtgggtcagaggataggaaaatgatgtgatcaaagcatttctgcagtgtgtgtgttgggagactaccagcagaatgaagttgccagcactggaagttgttttaaggaatgtgtttaggacagacagacaggaaggatgctaaatcactgagtcttggtcagcctaagagaatagtggggaggacaaacgtaggctgggagaattgagaggcactcgagaaaaatgtttgacccgagtttgatatggctcttgggctagagcccaagcattgttcgttacatggtccatcatagtcctctggtaaataggtcttttacttctcactctcaccccacaaaggttttcttgggggaagactgcgagaaggtctttgatagccattgaacctctttgaagaacagctaccataaattaccaaatggtggtctagcgttcataccagcagagttgggaaaacgtgtcctttaaagttgagataggctgggcccagtggctcacacctgtaatcccagcactttgggaggctgaggcaggcagatcacttgagctcaggagtttgagaccaacccaacatggcaaaaccctgtctctaccaaaaatataagaaattagccaggtatggtagtgcgtgcctgtggtcctggctactgaggaggttgaggtgggaggatcgcttgagcctgggaggcagaggttgcagtgagccaaaatcacaccactgcactccagccggggtgacagagtatctcaaaaaaataaagtggggatgcttgtaatatagtgactaatatatgttgaataacacagaagtgaatatttccttcagcaaataaaatcagatggaaatgcatttttccaaaactataattttcagaagagcactgagccatccgctcctcaccatccttgcataaatgaaggcccaacaggatcaattaagctcatttgttgacacagcctattaaaatacctccaggcctctaggaaaaaaaaatgagcccagaatgcactgtgcacaaagcaaaaactgatggaggaaaatcgattagcaaatgaaactgaatctgagaggcaagactagaggttgaaaggacttaatttgaaaattgtatataattttagcataaaattatgctaaaaagagggctgccattctgtgtgttcacttatgtgctttttaaaaagtacttttcttagttcacaccttataatgcatatgtctaaataagtattgtttccttcaaaatagttgtctttgaagtttggcccttgttctagcaatgttcacaggaggtggtgtcagaactcatggagcatccttttgcacatgccagtattatcccatttccatctgggaggatttagctttcataagaagccacaggttgtttagaatcaaagcttccaaataacacggctgatccagataagcgatttgggtttctaacaagaagaggcctgattttccaatgtggcatgtaaatttacagacaatttgcaaagttgagatgagaggaaaatcatttcaaagacgggctatatcactagaatatacttgtaaccccctacaagtaaattttccctaattagaaatagctttatatttttctacttatgatcaacaatttatacagacaaaaactgtatttaatcccactgccaagaagtacctatgactgatatttttgtatattttttaaagtttgcttgtacttgtagagtttgaaatgttgagaatttgaggaggaatgggattatgctatataacaattttattttgtcatttacttaaatgggtatcattctgtatcaaatatggaatcatttttaatggctgcttggtgtcatgttgtagaagggtttcataatttatttaaccagcccccttctcatgggcatatatgtgacgttcacttttttgctattatcaataacaaaactatgcatgttgttgtcattcacaattctcttatttacagaaaggcctgaacttgttcttcccacttcctaatcctccctcagtctttctcttgagttaatatgcttttgaacgatgtctaacttaaggggtttccatggtcatcattttttgaaccacaaagaaggcaaagttcaaataagaatgttctactccatcgctgctcctgatgtagatgctagggatcctgatcttaatgttgttctgttggccaggagaggacaaattcaattattgcctgttggctagaccacagctctaggcagccatccccatgggaacccggaggacaaaatgaacattcagttataggtcactgtgatgccgcagtgctctcagctcacataatatggtgatacagtcagtcagagaaggaatagagggacctatttatgaattatctaatccatcctctgcattctataagcataatggctaagttccgggaaggtgaagttgcctgcccaaggttgtatggccacctgggagacaatgtaaagcccccacatcattgaacaggagatccagagttacaccttgactgggccttctgggaccctaaaactgcgttctatgagcacctgagtcaaactaattagtcaaaatggggtcataatacctatgtgagacgatggtggtgaaatccatgaaacggtaagttctcaacacagttattttccagaattagtaaaaaagtagcatagtattagtagtagtgttattgttgtcattgtagctattaccattgtggctatgtggtagcaatggtagttgttattgcattgtaagagcagttgtagagaagaggccaggagaggactctggtagtggtagtagcagttcttctagtagaaataggcactgttttgtggtgttgttggtgttgcagttgccatagctgttacagcgatagctgctgacatggtagaattcaggcagaaggaaggcaagatgagtatttcctttattttacctatcttactaaagctcctaattcattattttgaaccccaggtaaaaggcagaattcagtctgagatgtacacatccttgtgtgcttctatgaggatactaatcctcattgtttcctgcgatgcaagaaagcacaaagtcatctacttctagttcacaccacagcctcatttgcctctgaccccagggaaactcagttgtttggttaaagctataggagaggccaaatgtttaaatactgaagtaaatataatgtttatcacagtcacgtttttaatttcttttttctacttgctttcttgacaaaatgagttccttttgctaagtgtgtggctttaaaattttaatggagagggagaagagaaatgtgtctatgtgtaggcaatcacaattctcatgaatataacaagtggatcctatccaaggttacatcttcaaatcttgtgtatggatttattcattgactccctacaggattaacgggaatcacactgataaattacaacccataacatttttttcaaattaagggccagacatctgctaaggatgctcaaaatcaaattaatttttttcctatgttcatattcagatattctgaaagagaaaataattatctaaccttacaagaaggcctgcagaaccagcaagcaaccctttctgttggaatgctctatctagtctgtgcttccttcaattcatctgaaggtcattttaaaaattcaacatccaaaatggtcttaagaaatagccatgatttacacgatggtgcgaatgtttatttaatgcatgttatgtgccccacacagtgctaggggtcttctcttatgctgttgcatcaacctatgagactggttcaatgagagggtaccattggcatctggtgggtggaaatcagggatgctcctacacaccctaccatgctcaggacagctcccacaataaagaattattcggctcaacatgttaacagtactgaaggtgagaaatatagaattagtcttccttttcatttaactgttcattccttcatttatcacacatttactgagcacccataaatgtgtgatttccccacatatatatacagaatatacagaatatttctcttcgcaataaggaactctgagtatatatactatttttcaaaaggtagctcaggtattatctataatacaatccccaggagtgcttcaaagatgcagattcctggggcccaccccacagctcctgagctaaaaatctctcaggataaggcccaagagattgcactccatttttcttcatgttaaaatttaaaaagtctgaactattaaaaatgcaacatatttatgacataccatataggccattttaataagacaatataaacaatgatatggaatatttgaaaattttaaaataaactaaatgcacaaagaatatttaattgacttttattctaccaagtttcacagatgttaaattatttaacacacacaacaaccctcttgagtaaataaatattgctcatattgctcatattaataccagttcagataagcagcactgatatccaagttagctgaagacctaccacttacaggggctgaggaacttgcgcaggttcacatggttgggatgtggcagaatcaggacccaaagcccacagaaactgcagtatccacacttcccaacataatgggaaacctgccaaatttctctgtccctttcatctcttccagatcccgctgtccacagttatcctatctcctcttgttctcagcaggtacccacccagagacccctccccagccctgtgccagcagcccaaggtggccagcctcgagtcgggctctttatttgaatcctagttagatttccaattcatttgttagaagtggagataaattaatatttctaaatgttcacaaaaggagaaattgctacaatttacaaactatacctgactctgttctaaaaaggatataacctaaggaaaggctcagttctgaatgtctgaaggcacatgtgtgtatgagagagcatccaaaactgttcctctaatgcattccccaggtgatcctaacactcagagagtttgaggctcactttttcaggaggtaagagaaaccatataaattacaacatatccagccaaatattcaaatagataaagtgctatttaaattcaatttagcattaaagcttaatccttccactatgtgaaatttctttggctaccccacaatgcaacgatctcttaaaatattcataaaacgtaattgttcactaattgtttctgagaatagggttttccttttccatctagatgtaatcccttagagtaccatggcttcgtatttcctggtgtgtctctggggtctaccaaaggctcagtcagccaggattgtggcctgactattgaatggcatgggtcggggaagcaacacagaatctatgaaaaaaaaaaatcaatttttctcaacactaagataaacagtgggctgatgtctatctaaacatgagtcccaggtggaccctggccctcttcccttaaatgtattagtccaatcctagtatttaaaaagtccttttattaacgtggattttcccccttttgagagtttgtcacagcaaaaaatagcagaacagatcaccaatttcttcagtgatagaagatttattactggcatatcgatcctgttctcatctgccatgatgaagatcccagctgctcagaactccccctctgacaaaattctccatcactgtcacatgtggcccaacaatgaaccttcctagactgcttgagaagcagaggagacttgctccctacggaacacgtggattttgtgtctgccccagtcagttgttttgtggggtcagttttggagaattggctctggttgctcaaatggttccagaaccatagaatacaaataccagtgacactggaagaggatatgtaaggtattattttagaataattcaatattttactatgttttagttttttacctattgcacaacccgaatcactaaatcacctctcaaacagttttaagacaacaacttctgctgtcaccaaccgagcttcccagccccgcctggtacaccatgtataagatttgagtgtgcaaatgcaatgcaaactaaacaattatgggtgtggtactcatgcaataaagaacccaaccaagtcacccatttccattttatgaagtgcctacagctacagttcttggaactgatgaaatgttcagagactaatatactttttgtcatagtaatgaggtgaaaaaaagaaaatagaaagtgatacaaaatgccaggttttattacaaatttctttctggcagtttggttagatttagaaacatttcattaagagatatgcagccagagtccatgatgtgtaaaaggatgaataattttccaaagcaaatacaggttctttccctttcttgtctactctggcacccaagtactaacactttgtctcctgtggctggtggatccaattggaatgacaaaataagaaaattattccatttggaatttcgtttttggtattgatcagtagaaccaaatactgagtagcattaggagtaattttttagatggttaaaataaatggtaacttggggtaaacaacttaggagaagacatgatgcatgaggcatgtcggccaaagttacaaaagaaaattgacttggcccttgtttaggcctctagacatgatccgaaggtagaggttttgctagaaatgaaataatactaaaaaacgtagtcctttagggcaaactttgggtttgatcgacaaatgtttatttcagttttacaagcactgcccagatgcctgtgttgctatattgggtaaaaccttgcttgaaactatcaggcaggcatatatgtcttcttgaagtcccttccaggctagtgagagctccagctgatacaagcaagccacaggaaaaggacttaggaatgactcttgatctttcaatgcagcaaggagaattgaacaaactacttctttcaggcttgtaaagaaaaatgtcctcactttatctttgaccttctgatatttctcagttttaccatatttctttatttgttgtttatactcatgagatttcaagcaatttgtgaatagccgtcaaatgagaggagctgaaatcttggaaattaccatctaggggctaaaatacaagaatggtatttctgaacaaaatgcaaaacttacatacagaaggaatattactttttatgaatcaaggcatcaagcaagtcaggattaagtggaaggaaatgtctttgaaataacagtatttgtgatttattctcatctgttatatttcaagctaattatcttttaggtaaaaaactaaaaagattttaatctgttttttgaagttcatccccatcaaattaggcagaatatatatacggagcttcttgctgtcaggagtaggctccagcagttatttaaaaattaatagcaactgcctttgtaatatttcactttttgacagacgtcaccatttactgactcctgagaagcttataattgttctaattctctaaggaaacagctttatgtgccagcaaactatttgcctcaatttaagatcaaaaaggaaaattgagactttatcttaacagggtcatttttaggtacaatatgtaatgtatgcaaaatgtcttacatacatgggtaattattaaggcattaaatggtagcaattaaaagttgagctctggaataagttagacttattctatttactattaaacttattctatttactaaatagtctatttactatttgagcaagttttgtatcccttacagcctcagttttctgatcagtaacacgggaataatgacactgatcttatgaagttgtaggtaataaaaagtgcctagaacacaaataagtaaacttttattactattgttctcctatttcaagaatattttacttctcataaagaaaaggggacaaagttactgagcacctaagtatcaaactacatgatatgtattatatatctattccattcatgcctttataataggggttgtggtcctctttgcacacgggaactatgaaaagcagaggttagataaatatcatggtctcacagctactctctagtcaagtcaggatttgaactaaagtttggaccccacaaccctaggatcttattcactattgtgcactgatatgtgttcagtggcactctggaaagggaacagtgacagggactgaggaaatcagggcccggagaggctacataactttcacaggaccaaccagtgacaacacgaagactgattccagccttctgactcctgccggggcctgcttcctctgtattcaaagctagcaataacaggccaagtccatcttgcactccaaatctcctgcctcttcttccatggtatgattcaactagatcatttccctcccttaccaacccccctccctgcaaagatggctattctaaatttggaacaccaaacctatcttatatgaattatcaaatatttagctcttctaaatgactttttctattttattgaggctcttttattgccgtgctacatagcaggttcaattattatataattgaagaaacctattccagtaatattaacattgtactatttaataattagcattttactatagattcacacaacgaatgctggatctacatgacctcttcctgtacctgtcagacatcacgtcttactttttaccccctcacatgttcattccactccagtcaggctggctccttgctcttacctgtattccttctaattcttatccatgtcttagagctttggcactaacttcgacctgagatgtttctcccccagatagccttataggattcctgttggacctctgggcttttgcttaaatgtcacctcctcatcagtaagggcacacctaaccccgctttttaaaattgactgctactaaacttttgatcttccttctcttgcttttaggcctctttaaccaccttctaaaatatgtaattaggcttatagcttatggcctatcttgcctggctagaatgtaatctcaataagggccagaaagaagttacaaggacaagaatctttgcattttattctttagtgaaaccaagcccttagaagggtggctagactacttatttggcaaatgagtgaatgacttctagttaaaattcatgcttttctgattttgttggagattaactattcagacaatgaccaactttttcatccggggggaccagatagatttcccttgattcatgacttctttacattcttcagtgagactcaatagttacttccttatatatcccactctaatgatgccatcaactcctatccctaacagtggctcacaacagccatgtttcccttcagcagggcctaatcacttagcaggatgtgtcactgttccagagaataatattatttgggagtcttcttcagttttaataaagaacactattgatctttctgtatatttatcttttatctaaccacacaatgcaaatctgcatctgttctaataatttttaagttgattttcttgcattttaggatagaaaaaaatttattgtatagaagttatcttttctgctagactgtcatttattttttgtgttgttgcattgactaagacatctagtgcaacattgaataatagcaataaaatactaggcatcagtaacttttttcctgactgtaaaagctgcatttctcatgtttccttataaaagattatctatgctcataagattgattttattcattgttttactgagaattctatttaaagtactatatgtggaattcaatcaaatccctttctagcctctagatatataaaatcttttttttcttccttttcccagaggttagcaaaacccactcttgttttaataatgttatactgaaacacagcctcacccatttatttacatattacctaacactactttggggccacaatgaaagaagtgagtacttacaacagagattgcttttgcacagggcctaacatattcattggccttttacagaaaaaagttttttgacccttcttttagcctatttatatacatatgagattaataaaactacaagtgttcaactattctgatcctgctttagtgtaaaactacaatgttaattgtagcaaaagttaattctttgaatactttgctgaattcattcaatattttcttttggatttttaaactgttaggagactggtccgtaatttttcagtactatttataggttttggaattagttttgttactttgataaaaataaattgggaaggtttccatctgtaattggttagctcaggttgccataacaaactgccacagactgggtggcttaaacaacaaatttatttctcacacatctggaggctgggaagtccaaggtctaggtgcaggctgattccatttctggagaaggctttcttcccagcttgtagatggctgcttccttattgtatcttcatgtggcagcaagaaaaagacagccctctgtctcttatttaaagtcactaatcctactggattcgggccatacccttaggacttcatttaatcttaattacctctgaaagatcctgtctccaaatacactcacactgaagattaggacttcaacatatgaagtgggagaaaaacaaaattactggatagcatcatcctcacacatgctctaaaacatattagttttgtagactcagcaacataatatttttctcctgctcctttgtagggcatagatctgttctaccattttcaacttactttgtgaatatgctgatcatgaatctattttaaatatttatctcaatcatttctttaatttagatttttaaatagacatgagctttatacagcattttttatagtttaaaaatcttttccagatataccaataagttccttctcattccaaagttgtcttgtcttttttgtaattcaaactagcaaaaatctatttttttgtccttttacatatatccagctctcacagttttctctcaaatctccattttttattttcaattaattctttaatcttaattctttcaaactccttgtcagttgttttattctttttatattactgaacggaatgtttatttgttgctatttttttccttttcagtggaactgttgaagaccaggatttttttttctttcgaagatttctattcctgcatactatacactttaagtacaagtctcattaacaatactttccaaaggtctgtgatttcactgttgaaatggctgtacttctcatgttacctgtaaatgatgactctttgacctaaggttcattagaaggtttcaagattcattagaagatttcgtttccaataggttaaacttttactatgttacccttaaatgtgtcttgtactgcttctgcttcagggacttttaggaaattttctattgtctctttgagtatagtacccctatttttctctgtgcagactcaaggggcaggtctctacagaccaccaagacagtgactcttctcattctccatccaaatgctttcttgcagtgatggttgtttgtaggaatataacagaatgtctttacggctacttaacattttatctccggttgtaattgagccagtgcgggggaaacatatgtgaaataaccagcaatactcagttacacagacttaatataacctctctgtaaactcaagttctttgtatgcagcccaaagacctccccaacttatctcaatgtgtgggttactcaacctctaattactggcaataagaatttgattcgcgctggttttgatttcttttctacataacttgctgtgaattttcttaaaatgttatcattatcacaaagcatgggccatttcacgggcaactgagaatggaatatatacacttgtcagtgtttggtgaaactctctacttggtcaaatatcagctgtgctcctgtcttctgctgctttcccaccattgaaaatatttggcaattttcttggcatcatctcactattttctcacttttcctataaggtcttatattttttcaaaaagaaatttaccacttattttagaatgttatttttttccacatttattgaggtataattgacaaataaaaatagtgtgtatttaaggtttgcaacataatattttgatatacatataccttgataaatgattaacaaaattaagctatcaaaatattaatcacctcacaatcatctcttttttggcagtaagaatacttaaaaattattctcagcaaattacaaagattgaatacattttttaaattaaactttaagttctcagatacatgtgcagaacgtacagagttgttacataggtatacacatgccatagtggtttgctgcacccatcaacctgtcatctacattaggtatttctcctaatgctatccctcccctagctccctacccactgacaggctctggtgtgtgatgttcccctctgtgcatccatctcttctcattgttcaactcccacctatgagtgagaacatgtggtgtttggttttctgttcttgtgttagtttgctgagaatgatggtttccagcttcatccaagtccctgcaaaggatgcaaaatcatcctttttatggctgcatagtatcccatggtgtatatgtgccacattttctttatccagtctatcattgatgggcatttgggttgtttctaagtctttgctattgtgaacagtgttgcaataaacatacatgtgcatgtgtctttacagtagaatgatttataattatttgggtatatacccagtaacggaattgctgggtcaaatgatatttctggttctagatccttgaggaatcaccacactgtcttccacaatggttgaactaatttacactcccaccgacagtttaaaagcattcccatttctccacagcctctccagcatctgttgtttcctgaccttttaatcatggccattctaactggtgtgagatggtatctcattgtggttttgatttgtatttctctaatgaccagtgatgatgagctttctttttatatatgtttgttggccagtgtcttttgagaagtgtctgtttatatctgttgcccacttttcgatgaggcttttttttttctggtaaatttgtttaagttccttgtagattctggatattagccttttgacagatggatagattgtaaaaattttctcccattctgtaggttgcttgttcactatgatgatagtttcttttgctatgcagaagctctttagtttcgttacatccaatttgtcaattttcgcttttgttgccattgcttttggtgttttagtcatgaagtctttgcccatgcctatgtcctgaatgattgcctcggatttcttctagggttattaaggcttaagtcttatgtttcagtctttaatctatcttgagttaatttttgtataaggtgtaaggaaggggtccagtttcagttttctgcatatggctagccagttttcccaacaccatttattaaatagggaatcctttccccattgcttgtttttgtcaggtttctcaaagatcagaaggttgtagatatgtgttatttctgaggcctctgttctgttccattagcctacatatctgttttggtaccagtaccatgctgtttttggttactgtagccttgtagtatagtttgaagtcaggtagcaagatgcctccagctttgttctttttgcttaggattgtcttggctgtatgggctctgttttggttccatatgaaatttaaagttgttttttctaattctgtgaggaaagtcaatggcagcttgatggggatagtgatgaatctataaattacttttggcagtatgatgattttcatgatattgattcttcctatccatgagcatggaatgtttttccatttgtttgtgtcctctcttatttccttgggcagtggtttgtagttttccttgaagaggtccttcacatcccttataacttgtattcctaggtattttattttctttgtagcaattgtgaatgggagttcactcatgatttggctctctgtctgtctgttattggtatatagaaatgcttgcaatttttgcacattaattttgtatcctcagactttgagcatttagtccatttatatttagggttaatactatgatgtgtgaatttgatcctgtcattaggatgctagctagttattttgcccattagttgatgcaatttcttcatagtgttgatggtctttacaatttgatatgttttgcagtggctggtactggtttttcctttccatatttagtgcttccttcaggagctctcgtaaggcagtcctagtggtgacaaaatccctcagcatttgcttgtctgtaaaggactttatttctccttcacttatgaatctcagtttggctagatatgaaatcctgggttgaaaattcttttctttaagaatgttgaatattggccttcactctcctctggcttgtaggttttctgcagagatacctgctgttagtctgatggccttccctttgtgggtaatccgacctttctctctggctgcccttaacattttttccttcattttgaccttggtgaatctgatgattatgtgtcttggggttgctcttctcaaggagtatctttgtggtggtttctgtatttcctgaatttgaatgttggcccgccttgctaggttagggaagttctcctggataatatcctgaagagtgttttccaacttgattctattctccttgtcattttctggtacaccaatcaaatgtgtatttggtcttttcacatagtcccatatttcttagaggctttgttccttccttttcattcttttttctctaatattgtcttcacactttatttctgtaagttgatctttgatctctgatatcctttcctctgcttgatcaattcagctattgatacttgtgtatgcctcacgaaatacttatgctgtgtttttcagctccatcgggtcatttatgttctcctttaaactgattattctagtgagcaatgcctctagccttttttcaaggttcttagcttccttacattgggttaaaacattctcctttagctcagaggagtttgttgttattatccaccttctgaagcctacttctgtcagtttgtcaaacttattctccatccagttttgttaccttgctggcgatgagttgtgatcctttggaggagaagaagcgttctggtttttggaattttcagcctttttgcactgttttcttttttctttttttttttttttcatcttcatggatttatctacatttggtctttgatgttggtgtcctccagatggggtttttgtgtgggtgtcctttttgttgatgataatgatattgctttctgtttggtagttttccttctaatagtcagacccctctgctgcaggtttgctggagcttgctggaggaccctccagaccctttttgcctgggtatccccagcagaggctgcagaacagcaaagattgctgactgttccttcctctggaagctttgtcccagaggggcacctgccagatgccagccagaactctcccgtatgaggtgtctgtcaacccctgctgggatgtttctccctgtcaggaagcatgggggtcgggtacccacttgaggaggctgtctgtcccttagcagagctcaagcactgtgctgggggatccactgtcctcttcagagtcagcaggcaggagcatttaagtctgctgaagctgtgcccaccaccatcctttcccccagttgccctgtcccagggagatgggagttttacctataagcacctgactggggctgctgcctttctttcagggatggcctgcccagagaggaagaatctagagaggcagtctgactacagcggctttgcctagctgtggtgggctccgcccagtttgaacatccaggccagtttgtttacactgtgagggaaaaaccacttaactcaagcctcagtaatggtggacacccctccccacaacaagctccagcatcccaggtaaacttcagactgctgtactggcagtgagaatttcacagcagtggatcatagcttgctgggctctgtgcgggtaagagccactgagctagaccacttggctccttggcttcagccccctttccgggggagtgagtggttctgtctcactggcattccaggtgccactggggtatgaaaaaaaaaatcctgcagttagctcggtgtcggcccaaatgactgctcacttttgtgcttgaaacccagggtgtaggcacccgagggaatctcctggtatgtgggttgtgaagaccatgggaaaagcatagtatctgggccagaatgcactgttcctcacagcacagtccctcgcaacttcccttggctagcagaaggagttccccaaccccttacatttcccgggtgaggcaacgccgcaccctgcttctgctcaccctccctgggctgctgtacccactgtctaacgagtaccagtgagatgagccaggtacctcagttggaaatgcagaaattacccaccttctgcattgatcatgctgggagctgcagactggagctgttcctattcagccatcttgccagcctcacagatttaataagtttttattaactattgtcattcacaccgtacatcaggtctccaaaaaggatttatggcttttttcccctggctaggacctccagtaccatttttaatactggacatccttctgtgagcatttagttttttatctttattatgtttgtgctagtatttttaaatttatttttgtcatgtaaaatacatatttaatataaaagttacctctaactatgtgtacagaccagtggcattagatatagtcacaatattgtataaccattaccactatctctatccagaacttttttactatcccaaacataaactctgtacccatcaaataataattccccatctgtccctccccccagaccctggtaaactctaacttttgtgtctttggatttgcctgttgtaagtgtctcaaataagtggaatcatacaatatttgtccttttgtgtttagcttatttcactgaacatgataatttcaaggttcattcatgtagtagcacataccagaatttgttttcttgttatggctgaatactgttccattgtatagatataccacattttgtttatccattcatctgttgatggacatttgagttggtaccaccttttggctattgtgaataatcctgctatgaacatttatgtacaaatatctgttcgagttcctgctttcatttcttttgtgtatatacctggagtagaattgctggatcatatggtaattgtatgggaatagaatggtaattctttatttaaggttttgtggaaaccaaactgccactaagcagtggcaccattttacactctcaacagcaatgctcatgggttccagtttccctatatctcaccaatactcattttccagttttttataatagccttcataatgagcgtgaagtgatatgtcactgtgattttgattttgacattccctaatgatcagtaatgttgaacatattatgtcttattagttatttgtatagattatttggagaggtacctattgaagtcttctgctcatttttttaattgtgtggtttttgagtcatagaatagtctggatattaatcacttaccaggtaatatttccaagtattttctcccattctttgaattcccttttcacattcttgttggtgttctttgatgcacagaagcattacattttgatgaagtcctatttatttatttgcttttttgttgctatttatctatttgtgcttttggtgtcacgtttttaaaaatcagtgccgaatctaatgtgatgaagattttctgctgtgtattcttctaagagttttatagttgtagctatttgattccttttgagttcatttttgtatatggcataaaagtccaacttcattattttgcaagcagatatccagttttcccagtattgtttgttgaaaagacaagtcctgggctgggcatggtggctcatacctgtaatcccagcactttggggaagccaaggcaggtggatcacttgagaccaggagttcgagaccagcctggccaacatggcaaaaccacatctacttgtgaggctgaggcaggagaatcacttgaacctgggaggcagaagttgcagtgagctgagatcgcaccactgcactccagcctgggtgatagagactccgtctcaaaaaaaaaaaaataaatcaaatcaatgagccataattatgagggtttattgctgggctgttttttccctttagtctgtgccttatgccaataccacactgtttcggttagtatacttttgtggtatagtttaatatcagggagtatgatgtctccaactctgttctttttcaagattgttttggtcattgggagtttctagagattacatatgaattttaggatgcattgtttttttcttttctgtaaaaaactccattgtgattttgataagacttgcatcgaattggtagatttctttgggtaatattgtcatcttaacaatattcttccaaatcataaacatagaatgtctttccacctgattatgtcatctttagtttttctagcagtttataattgtcagtgtacaggtcttttgtctccacagttaacttattcctaagtattttattctttttgatgctactgtaaaaaaattgttttcttagtttcttatttggattgttcattgctagtgtatagaaatgcaacttatttgtgtgaattgattttgtaccctgcaacgttgctgaattcatttaatggttctaaaagtttttgtggaatccttagggtttcctatggataaaatcatgtcatctgaaagcagagataattttactatttccttttcaatatgtatgcccttttatctaattgctctgactaaacttcttgtactatattgaatagaagtggtgaaagcgacccttctcttcctccttatcttagaggaaaaattttcatgctttcaacatggagtataatgttaggtgtgattttttcatatatagcccttatcatattgaggaagttcccttctatttctagtgtattgagtatttttatcatgaaagggtgttaaattttgtcaaatgatttttctgttaatggagatgattctgttttttgctttgttttttttaacagaatctcactctgttgcccaggctggagtgcagtggtgcaatcttggctcactgcaagctccgccccccaggttcacgccattcttctgcctcagcctcccgagtagctgggactacaggcacccgccaccatgcccggctaattttttttttgtattttttagtagagatggggtttcaccatgttagccaggatggtctcgatctcctgacctcgtgatccacccgcctcagcctcccaaagtgctgggattacaggcgtgagccactgcacccggcctgttatttttttcttccttctgttcatgtgacgtattacatttatcattttttgtatgctgaattgtccatgtatcccagaaatgaatctcactcttgacatcctgctgaattcaggttgctagtatttttgaggatttttacattaagagatattaagggatattagtctgtagagtttttttcttcttgtagtatttttgtgccgtattgatatcagggtatttctggcctcacaaaaagtactggaaagtgtttcctcctcttccactttttgtgggggagaatttaagaaagattggcattagttctttgttaattgttggtagaagtcaacagtgaagccatccagtcttgggtttttctttgctgagaagatttttattcagttattttaaaggttacatatctattcagattttctatttttttattagtcagttttggtagtttgtgtctttctaggaatatgctcgtctcatctagattatttagttttttggtgtaaaattgttcattgtattctcttttcatcctttttttaaaaaaagagtctcactctgtcactgcaggtggagtgcagtggtgcaaccagagctcactgtagcatcaaactcctgggctcgagcatccacccacctcagactttcaagtagctgggactattggcacatgacaccatgccaagctaattaaaaaaaaaaaaattaaaggtagagtcttgctatgttgcccaggctagcctaatcctttttatttctgtaaaatcagttagaatgcctctactttcatttctgattttagtaattctaagatttttctctttttctgtcagtctagttaaaggtttttaaattttgttgatcttttcagataactaacactttgtttccttgatttttctgttgtttttctcttctctagtttatgtccactctaatctttctattttttttccttttgctacctttaggtctactttgctcttctttttctagttcctaaggtgtacagtttattgatttgagatcttttttaaagtatacattcgcagctctaaacacccctcttggtgttgcttttgctgcatcctgttagctttggtttattgtgtttcatttaaattcatctctaagtattttctaatttcccctgtgatctcttctttgacccagttgttatttaagagctttttttttcccataattccctttaccaggttgaaggaattttcttcactagctggcttgctaagagtttttataatcgatgggcatcacatcatgtccagatatatttttccatgcatcaagatgaccattcttctttatactagtaatacaacaatttacattaattgatttttaaatgttaaaccaatcttcagttcctggggttaaaccaatcttgagttccttgggtcaatccaagacggtggctgctagccacatatagctattgagcctttaaaatacagtcttttttgagatgtgctataagaggaagatatactctagatttataagatttattattaaaaaatgtaaaatacctcataatttttacattaattactgaaataaaattttggctctattgggttaaacaaaattattaaagttaacatcacctattaaactctaaatgtggcttattgcacatttaaaattatatatgtgactcatgtctgtgtctcttataatattggtcaaaatattttttacgtatgtctagatttaataatattttgttgaagatttttgtgtcttttaaagagtattcaactctagttttcttttaaggtctttttctggttttattattacgctggtactggactcagggtgggaagggttcgttattcctttatcttcaatggagtctttatagggttggtattatttcttcattaatttcatgataacactaaacaataaaactgggcctgcagtatgtttatagaatgtctctaatagagaactatttcaagttgtatatttcatgttaagttagttttggtagtctgcatctttcaaagtatttgtccatttcttctatgttaacaagtctattgaaataaaattgtttataacattgcatcgctattcatttaataatgtaggatttgtaattcctgctatgggtaattcatgctttctttcatcagcatcagtctgactagagatttatcaattttattatttcattcaaagaacagtctttgatttcattgcttcttctctattgtttgctggttttccacataattggtgtccccttttatcttaattactctcttcattctacttatttggggttttatttcatcttcactttacactttccctagtgatggaggcctttagagttctagactgtccatggagagtctcctatcagaatctccaatgtgtatgtttccgtgggctctgacttctccctgagagccttttaaagttaaacttgaaaagaccagcaaataccctcagagcatagcttctattccctgtttaattctctgccttttcagtttttcttccatttttggcttactaatgtcttactattctgtttgttgtttttaagaagacttatttgatcatttatctagcacttcttgtttttccatgggaggatttgtatgtaaaagctagcttcccattacaaaagctgtagtccctagtagcatttccattttgtggggccattgtctcaaagccactggtgtctttttcattcccttctcatattccaccagaacgttgaccattgtgctagtttcagaacatagaagaatacgatgttgaattcactcccatgtcttacatattaattttactccttttaataatatttgtatttcttgagagactgtaagtagagactgtaatattttgtttttatgattccaaaagtaataacccttgaacatagtttttaaagaatgaagagagaggcacggtggttcatgcctgcaatccaagcaccttgggaggccaaggtgggcagatcacttgaggtcaggagttcgagaccagcctggccaacatgggaaaaccctgtctctactaaaaatacaaaattttctgggcatggtggcaggtgcctgtaatcccagctactcacgagtctgaggcaagagaatcacttgaacccaggaggcggatgttgcaatgagctgagattgcgtcactgcactccagcctgcactcactgcactcactccacagagtgagactctgtcttaaaaaaaaaaaaagaaaaggtacctatagctcttcaacctaaagataactgcaatgaataagttgccgtattctctgccaacagttttccatgtaaataggtatagacagaagggctaaccaagtgactttgtttaaaagaaatattatgtagctgcactgtccaagatggtggctgctagccacatatagctgttgagcttttaaaatatagtcttttttgagatgtgctatgagaggaagatatactctagatttataagatttattattaaaaactgtaaaatacttcataatttttatgttgattactgaaataaaattttggctctgttgggttaaacaaaataaattattaaaattaacatcacctattaactctaaatgtggcttctaacacgtttaaaattacatatgtgggccaggcacggtgactcactcctgtaatcccagcactttggcaggccaaggttggcagatcacgaggtcaggagatcaagaccatcctggctaacacagtgtaaccccatctctactaaaaatacaaagaattagctgggcgtggtggtaggcgcctgtaatcccagctactcgggaggctgaggcaggagaatggcgtgaacctgggaagcggagcttgcagtgagcggagatcacgccactgtgttacaacctgggcgacagcgagactctgtctcaaaaaaaaaaaaaaaaattacatatgtgactcatgtctgtgtctctcataatatttctattagatagtgctaatatatgctattttatattcttttttcagtcaacattagcgccggcactttgtgcataccacaaataattcttcaagattactattttaatagctattcaacttaaatcatttagggatactatagattgtagcatctagaaactttgtgtgtgtgtatgtatgtgtgtacgcgtgtgtgtctgtgtatgagacacttagtttttctttgttgttgttgttgttgttattgttgagacaaaaagttgattctcttgcttcaactgattctcatgcttcagcctccctagtagctgggattgcaggtatgcacctccacccccagataatttttgttttgctttttttttaaaaaaaaaaaaaaaagcagagatgaggtttcaccatgttgaccaggctggtctcaaactcctggcctcaaatgatctgcccatctcagcctgccaaagttctgggattacaggcatgagccaccgtgccggccaatacttagtttttcttgctgtaaaaattagattctactcctcagttattcagcaaaaatttgatgactatgtgttccttgttcatttgcttctttcctcatttcttcgtttttttctcttcctcctcttatccatttaccaaatattgttgagggccctgatagtctataggtagtataacataatgatttagcataattgcctctgaccagactgtctgggttcaaatccttgctcttgacttagcacctccattacttcaggcaggttacttaacctctcagttactgagtttctcagtgacaatataaagattatattaggttggtacaaaaataattgcagtttttgtcattgaaagtaatgaaagaagctgcaattacatttgcaccaataatagtcgtagttacttcatatgaagttgtaagtaataaaaaggattttatcaacacattttgaacaaggcctagcacatcttcagttccatgtacgttattatcggtgtttgccacctactaacagtccagcagggaaggcaggcactagataagttattgtaaatatgctcagtatcatgaaaggacaatctttgaaagttagtccaatgaataagaagtgttcattcctctccggtagttcagtctgctaggggagaaagacatgaaaataaatcatcttaatacagcaggctgaatgctaacagggactatgttcaaaatactgtagcaaataggaaagaggggctggctgctcctggtagcttctagaggcagtattctctgggctgagtctggaggattggcttttgcttttaactctagtcatttgattacatgtgtagattcatagaagacgttaatatcagtccacaaaataaaatgcttcgtgttttcataagtatattaggagtttatttgcatcagctggctacattttatatagagagcagattccatcagtattttcacgtggtgattcttagaatggagacacagaaggtatttcagcaaacaaaggaatgtctttcacaatagaagtgtaaacaatgccaattcagttcagagatgactttcttcttttgaagatgcctgttttcaagcaaaatacaaaatacactaacaataaaagatgccaaattttatcaaatgaagtaggaagcctttcccttaaactaaaagatgtaaacagtgagcaaaagagagctgtcaggagtttaaaaataagtttgattttaaaatttctttgcttttaaaatgggaaatgataatgactgaacttcatgaaaatactgcttagttaaattatccaatctaagtataatgctgaggtgactttatgtgtttctaactctttttcctagtgataagaactacacttaaaactgcctttattcaatcaagccttggatctgataagttaatagtcaatttgcttggcaaaagcaatttgattaaatgcttctctttgtgctggaaaaaatattgaattggaaagtttgcccaaagtcatttgttggctgggcatgatggctcatgcctgtaatcctagcactttgggaggcggaggccagctgatcacctgaggtcaggagttcaagaatagtctggccaatttggttaaaccccatctctactaaaaatacaaaaattagccaggcctggtggtgggcacctgtagtcccagctacttcagaggctgaggtaggagaatcacttgaacccgggaggcagaggttgccatgagctgagatcatggcactgcaccccagcctgggtgacagagtgagactccatctcaaaaaaaaaagtcacttgtccttggtttccctttcttcacaccatgtctatctaataagttaatgagtagtagccaaccttaaatagaaggaatgcctatgaatgaatggcatgaagatttttagtcaacacttgtaatacagtgtatctttcccattgttttgtcattcaattaataccaatgaggttttttatttgttttccttcaccttctcattgggaagccaagatgtttgtaaatccagattagtgatgatagcagtgaactatacctgctcataaatctatttgtgctagtgtattttgacgagcaaaatgtatatccaactcccactctacatatttcttttttccccaaatttatagcaataccaaaaaggatgcagcaagggacatacttattctatatgtttttgtgcttgtattttctttgtagattcatttctaatttaattatactccctgctttgccatgatttatgtatgattatagtttgtctttggatatataattctatctgcataaaatatgctgattaatgtaggctaatatgtttcaaattaaaaatatgtgttctttaaaactatttaatatgttgaagaaacttttaacacaattgctgattgggacacacaaatttctcttaaggcagtgctgagtgataaaacataaggtacatgtgtataatttgtgaaactatatcgccaagggattctgtgttgatttaatgtctctctcaacttcatgaaactaaaagaaaggtctggtccaatacttttcaataaagagtgaattttcctccagggaacatttggcaatatacggagacaatttggtagttacaactaggagtgggtgccaatagtgggtagaggccagggatgctgctcaacattctacagtacacagggcagctcccttctctaacagagaattatctggcccaaaatgtcaatattgccaagattgggaaaccttggtctaatctggtgaatgtaaagccctttcatatcctttggtgtggacatttatgtttctctagctatattagcccttgtcacagctacccaagcaacatctctcctgcttaattgataagtgaatacctcaatacttctctagctttaactaaataaattagcaatggtcctgaaaaattgagttgactgagctaatcccatctgcaccatcacaggcacacatgcacacacacatacatcccctcactctgtgtaccccagcatagaagctgtccctctcacatatatctaggcagcccaaaaattgcaatagttattctgacttgcagacagcatgccctgccatgttggttctttgtggctttttcatgaacccagtgagagaagcagtggtcaatagggaaagttcagtggcaccactgtgggtagtcactttctttccaagctagctgtgatttttgccaagtctaagctcttgtgtgccctggctttgaacacccttttcaatgtagttgcagtggagatgagtggatatgtgtttactttcagtaggcctgctgttttggcctaccattcccagtggtttgcaggacagagaaaatgatactgaataatacaaattgagtaattctgtgttccagagactaattctgcagactgtgccagacacatcttcctttacaggtatgagaaatgtatgagtattttcctttgaaaagctcaaaggagctgatgaggatttacattgtaggtgttcagagagccaaatttcaagaggaaagaaagagatgtcatagggcctgtctctgttcactcaaataccttaatttctactcctggatgtcagtcattcaatatgtaattaccaagtatttacagcatgcaaagcattcatgtggaactgttgatagaaggaagaacacaatataacttcttgtgattgaattcctcagaaagtttgggaaataggtgaaatgatcttgcacaagagtgaactcaaggcaggaggaaagtcataagtaactgaactcagacatggacttataatctttttaacatagcttagcaagtgatcataaccagtccatggaagatggtacctgaggtgaactctgtttgccgtctttgggctgtggactctaagaagtcacagtggtttgaagagaacatacaaataagtagatgggattttcatagcaagaaggatatttctagtacagcagggacacaattaaatcatagtgataggaaagtatttggagaagattacaaaggcatgtgagcagggatctgaggtctcatgaggtaagactgtcagaccactggtttcgggggggaaaaggtaagaatgtagttttagaattatgtaccttcaccccttctttcttattctcagcattctgaaattctcctcctcttcaccttctttttccacttttctttcctctcattttttaactctgcctttctgatatcattcatcactaagacggttgacaagaggaatttaataataaagagggctcccctcttcttgctaaaacagtttgacccccttatggttctataatttattaccgattccagcattctgcaaatgcaatttttaatgggcttaagtgatatcaggtcttagtgcattgataataattataatgatggtaaatattcatagctaacatttagtgggtgcaccccgtattctaggcatatatacataacttcaattcatcttcagaacaactctttgatgatagataccattaatgttcccttttgcagaagagaattatggaacttgcccaagatcattcagttaggaagtcattgagctgctaggctctgaagttcatgttgtgaataatgatgctactcaccctatagagaaaaatattagaataaaaccaatttattgggatgagaaataactgaggtatttaaagaacactgagaaattaaagtctaatgtgggaggaggccatggaaataagtggaggaatttgtgtattttcctagtcatgtcctcagttctgggagaaggagggaagctataaatttgctggatgaaagaaacactcccattgtcctgtatggatcagttgtgggaaagacttgactgacagttaggagatgagtaaacagctggggacaaatgggctggtgcagccacagagtctactgtttggggcacattattgtttctgaatacctctttgttccagatgtgatccacttgtcacgaatacatggccgctcaccctttctcttccaaaagccttgaaaaatatattagtctgttcctgtaccatcactgtgactcattaaatacctcttactggagacatatgtatgccttcatttccctcggtgcaagaaacatgcagaaaaagcaaagtcattcacaccttccctggcagtcagagttgttagtagatattgtttgtcaagattttcttcattgctgctaatgcacacatcatcacagtttgaattactccgtgaacctttctgatgtctagaagtcagccactcttactgttaggagagtttactctgtcaacaggacagctacattaccaagtctaattacacacttttttaaaaaaggaaaaatgtccacatatcaagtggaagtagaagtcaggtataacagggtagacaggctttttaattaaataatgtcagttacctcttgccatcagctcatagtttaattcaagcactcttgttataagaacactgggtcaagaatccatcctctggagtgctagggaatacaatcattcctgtccagctccagccagattctgtttggaggccattcccattgctttaattaggggaaaaaaattaatgttgtaaattcatagcatgtcactcctcatttctgtacaatccatcacactctgagcatgtgtatggcagctctttttaataaaggattttgcagagtacctgctgtggcaaaaatactttgtcatctttgctagctccaggagtcctagcattatgtcatgtttgactccaaaaaatattattataagccctggaattagaaacccaacaatggaactagctgatttcaattgcccgtgaagctatcatattttgagaaataaaacttggtaagttttcattttaatcaaaaactataacaggaccagggttgcttgtctgaaatgaataatttccacatttctggatgctatcagataatggctctctcatccgtgaattaattataaaactagaaatactctaagaatatcaagttgtatcccccatactttcttttaaagattactttatgtttcatcaacttggagctcaaaagagggaattgaagggcactcaagagccaattcttaaaacatctcataagctgtggcacctgggaaggtcatcaggggcttatgtcccagccatcaccttaggataactggctcatggagaagttccaagctataggaatagaaacaagaaaaacattttcctaataatatcattcaaggagcacatgtcaagcctcccccactctttcccagccaaggaacagccccctttgtattttagcccaattccatgaggtttaggtgctttctacttattccaatggtttcttttggattttgagattcaatcctgtttgcttttaaatgtcattgtttttccctctttaccatgttaatgcccagtcctaaatctcatcaccattaagagggaatcaacctcctctcccctacctggggtgcatgaggggagtagtagcaccactcaccagttttacgagtaagcttcctggaggactgtctctagactccagggagagagagtacctctcacctcatgcccctgagggaaatagagataatagctcttcttgcacatttatcttattaatagggtggcaaggtcaagttagagagaagggactagtccttcttcagtggtacctttaagcaagcattgccagaaatggctgccattttcactgtgactaagcacatagtgtatttccagtttcttccttggctgtgggtcttacccacgattctgggacaacaaggacagcctcctggctactgaccatcctccaggttcttcatgtatgctctgcttagcaaattaataatgctctgaactaagcttgtcatctcaatgatatggttcttatttttgtccccaccaaaatctcatgttgaattgtaatccccagcattggaagcgtggcctggtgggaggtgattggatcatggaagtggatttcccccttgctgttctagtaacagtgagtgagttctcacgagatctggttgtttaaaagtgtgtaacacttcccccttgtctctctccctcctgctttggccatgtgaagacatgcctgcttcccctttgtcttctgccatgattgaaagtttcctgaggcctcccagccatgctacctgtacagcctgcagaaccatgagccaattaaacctcttttattcatcaattacccaatctcagtatttctttacagcagtgtgagaatagactaatataccccatttgacagatgcgccatttggggaggtagcgtatcatagcagttaaatgggcaaagcagcatcagacatgagttcaggttgtaggctctgaaaatcacaactgctcaagagattcaggagtcatatgtgggtttggtctaccactgaccttcccctcatgctctgtgcactgattcttaactctggcttccctgcttccttccaggcctctctcaggtctaaagcttcctcacataaaccctaggactcccagaggtcctgttaatgtcccagatccaagcctttgctgaggttgctcagcccccttaaaagctcttccttcctcatccttcatgcaaatctcccttatgaaat
